(12) United States Patent
Reid et al.

(10) Patent No.: US 11,859,168 B2
(45) Date of Patent: Jan. 2, 2024

(54) ELECTROPORATION, DEVELOPMENTALLY-ACTIVATED CELLS, PLURIPOTENT-LIKE CELLS, CELL REPROGRAMMING AND REGENERATIVE MEDICINE

(71) Applicant: Christopher B. Reid, Los Angeles, CA (US)

(72) Inventors: Christopher B. Reid, Los Angeles, CA (US); Melissa Braga, Monterey Park, CA (US); Lilian N. Santamaria, Los Angeles, CA (US); Ashley N. Wickrema, Los Angeles, CA (US); Marinne D. Wickrema, Los Angeles, CA (US); Anthony Hao Dinh, Garden Grove, CA (US); Yaman Eksioglu, Atlanta, GA (US); Mat Hoang Ho, Birmingham, AL (US)

(73) Assignee: Christopher B. Reid, Los Angeles, CA (US)

( * ) Notice: Subject to any disclaimer, the term of this patent is extended or adjusted under 35 U.S.C. 154(b) by 41 days.

(21) Appl. No.: 16/579,889

(22) Filed: Sep. 24, 2019

(65) Prior Publication Data

US 2020/0048600 A1 Feb. 13, 2020
US 2023/0340397 A9 Oct. 26, 2023

Related U.S. Application Data

(63) Continuation-in-part of application No. 16/171,420, filed on Oct. 26, 2018, now abandoned, which is a continuation-in-part of application No. 14/764,195, filed as application No. PCT/US2014/013473 on Jan. 29, 2014, now Pat. No. 10,138,451, application No. 16/579,889 is a continuation-in-part of application No. 12/601,819, filed as application No. PCT/US2008/065007 on May 28, 2008, now abandoned.

(60) Provisional application No. 61/849,589, filed on Jan. 30, 2013, provisional application No. 61/064,761, filed on Mar. 25, 2008, provisional application No. 60/933,670, filed on Jun. 8, 2007, provisional application No. 60/933,133, filed on Jun. 5, 2007, provisional application No. 60/932,020, filed on May 29, 2007.

(51) Int. Cl.
*C12M 1/00* (2006.01)
*C12M 1/42* (2006.01)
*C12N 15/11* (2006.01)
*C12M 3/00* (2006.01)
*C12N 15/10* (2006.01)
*A61K 48/00* (2006.01)
*C12Q 1/6811* (2018.01)

(52) U.S. Cl.
CPC ......... *C12M 43/00* (2013.01); *A61K 48/0058* (2013.01); *C12M 21/00* (2013.01); *C12M 23/42* (2013.01); *C12M 35/02* (2013.01); *C12N 15/102* (2013.01); *C12N 15/1024* (2013.01); *C12N 15/1031* (2013.01); *C12N 15/111* (2013.01); *A61K 48/0066* (2013.01); *A61K 48/0091* (2013.01); *C12N 2310/141* (2013.01); *C12Q 1/6811* (2013.01)

(58) Field of Classification Search
None
See application file for complete search history.

(56) References Cited

U.S. PATENT DOCUMENTS

| 3,598,119 | A | 8/1971 | White |
| 3,660,243 | A | 5/1972 | Young |
| 4,160,700 | A | 7/1979 | Boomus et al. |
| 4,578,061 | A | 3/1986 | Lemelson |
| 4,675,298 | A | 6/1987 | Brusewitz |
| 5,244,460 | A | 9/1993 | Unger et al. |
| 5,419,777 | A | 5/1995 | Hofling |
| 5,431,168 | A | 7/1995 | Webster, Jr. |
| 5,650,323 | A | 7/1997 | Root |
| 6,309,370 | B1 | 10/2001 | Haim et al. |
| 6,733,993 | B2 | 5/2004 | Emini et al. |

(Continued)

FOREIGN PATENT DOCUMENTS

WO  WO 2008/150814  * 12/2008 ......... A61K 48/0058

OTHER PUBLICATIONS

Wang et al., "A complex 3D human tissue culture system based on mammary stromal cells and silk scaffolds for modeling breast morphogenesis and function" 31 Biomaterials 3920-3929 (Year: 2010).*

(Continued)

*Primary Examiner* — Nancy J Leith
(74) *Attorney, Agent, or Firm* — Katten Muchin Rosenman LLP

(57) ABSTRACT

The claimed invention is directed towards a novel combination cell electroporation/cell culturing apparatus which can be termed a cell culture dish suitable for in vitro electroporation, and towards a device suitable for in vivo electroporation—both useful in methods suitable for the generation of developmentally-activated, pluripotent, pluripotent-like, multipotent, and/or self-renewing cells which are capable of beginning to differentiate in culture into a variety of cell types and capable of further differentiation in vivo. The claimed invention is also directed towards the generation of desirable, differentiating somatic cell populations transplantable to animals or patients, genetic modification of endogenous and exogenous cells, and the treatment of patients suffering from diseases that may be ameliorated by these methods. This invention also provides methods for preventing, treating, or retarding disease, for example, immunodeficiency virus (e.g. HIV-1, HIV-2, SIV, FIV, etc.) infection.

26 Claims, 35 Drawing Sheets
(9 of 35 Drawing Sheet(s) Filed in Color)
Specification includes a Sequence Listing.

(56) References Cited

U.S. PATENT DOCUMENTS

| | | |
|---|---|---|
| 2003/0012769 A1 | 1/2003 | Poeschla et al. |
| 2004/0214313 A1 | 10/2004 | Zhang et al. |
| 2006/0269518 A1 | 11/2006 | Chang et al. |
| 2011/0172128 A1 | 7/2011 | Davies et al. |
| 2022/0298468 A1* | 9/2022 | Reid .................. C12N 15/1031 |

OTHER PUBLICATIONS

Geng et al., "Flow-through electroporation based on constant voltage for large-volume transfection of cells" 144 Journal of Controlled Release 91-100 (Year: 2010).*

Abelviovich et al., "Reprogramming Therapeutics: iPS Cell Prospects for Neurodegenerative Disease" 61 Neuron 337-339 (Year: 2009).*

Corbeau et al., "Anti-HIV Effects of HIV Vectors" 243 Virology 268-274 (Year: 1998).*

Anderson et al., "HIV-1 resistance conferred by siRNA cosuppression of CXCR4 and CCR5 coreceptors by a bispecfic lentiviral vector" 2(1) AIDS Research and Therapy 1-12 (Year: 2005).*

Czyz et al., "Embryonic stem cell differentiation: The role of extra cellular factors" 68 Differentiation 167-174 (Year: 2001).*

* cited by examiner

Fig. 17A
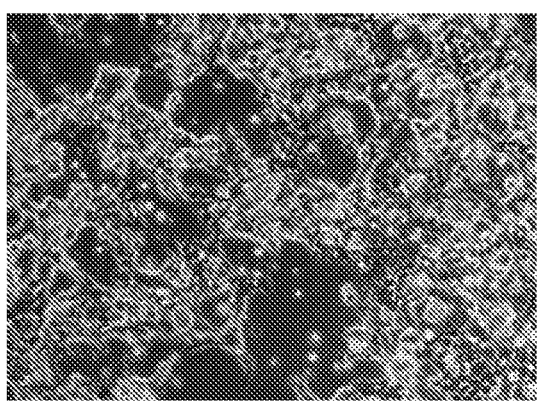 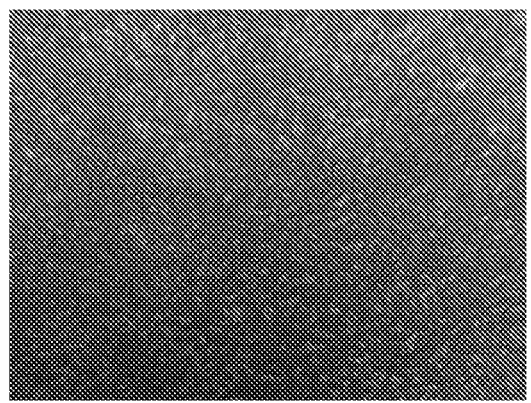
Fig. 17B            Fig. 17C

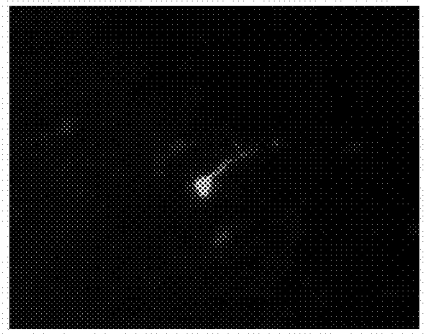
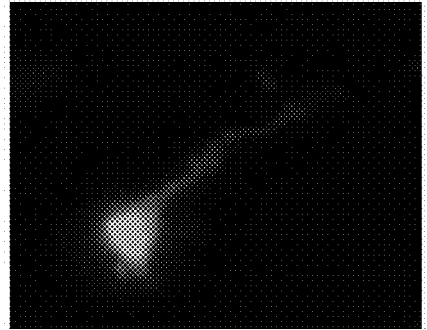
Fig. 21A　　　　　　　　　　Fig. 21B
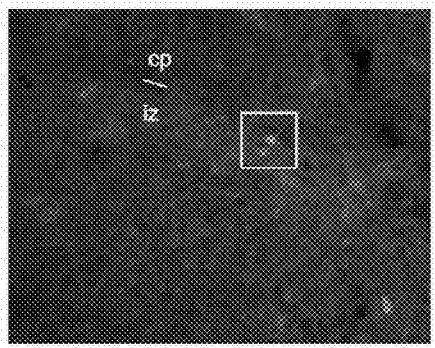
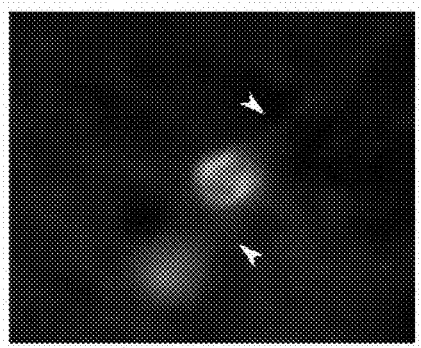
Fig. 21C　　　　　　　　　　Fig. 21D
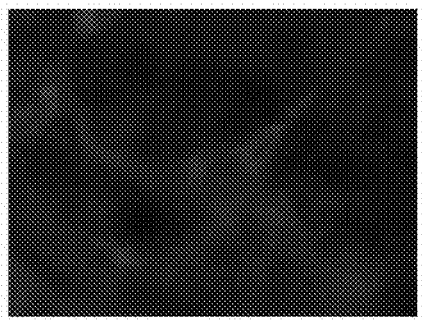
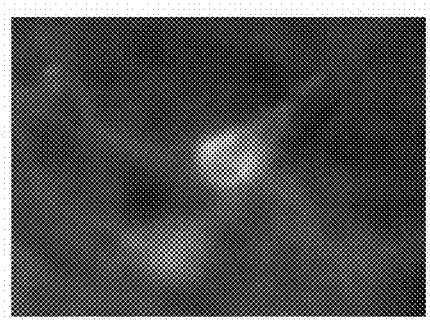
Fig. 21E　　　　　　　　　　Fig. 21F

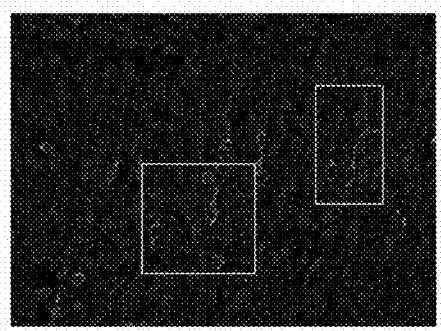  
Fig. 22A　　　　Fig. 22B　　　　Fig. 22C
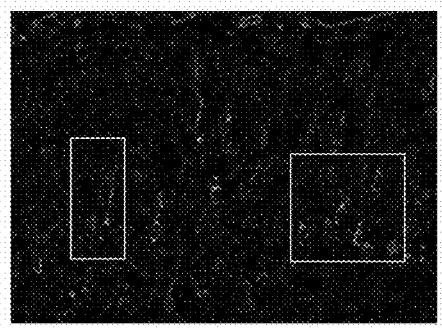  
Fig. 22D　　　　Fig. 22E　　　　Fig. 22F
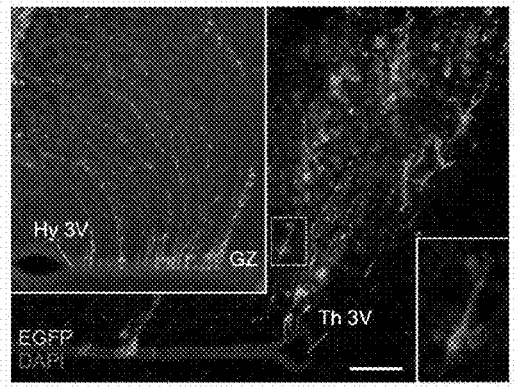
Fig. 23A
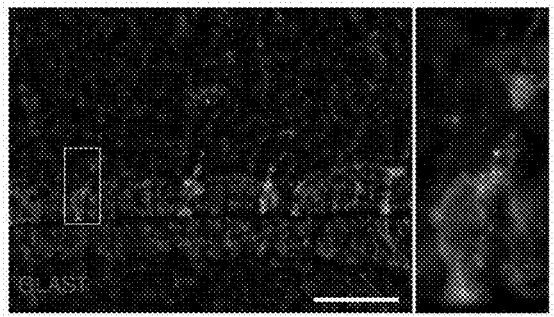
Fig. 23B　　Fig. 23C

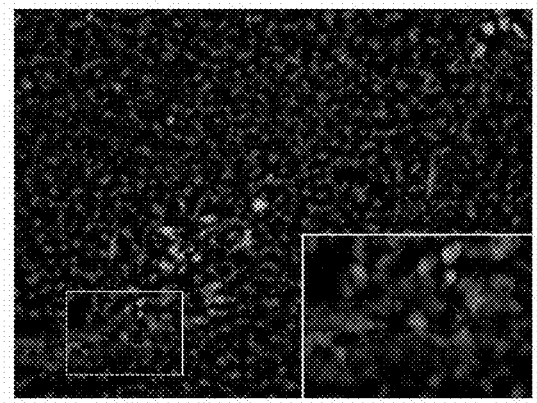
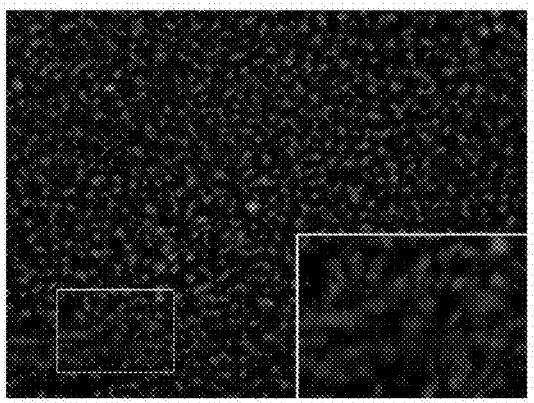
Fig. 24A Fig. 24B
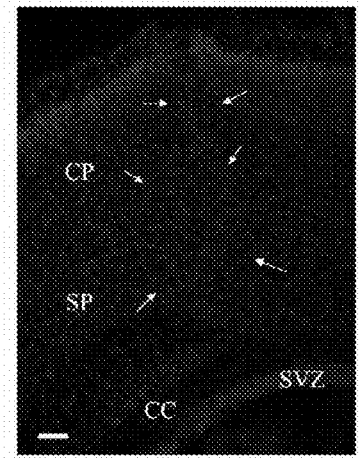
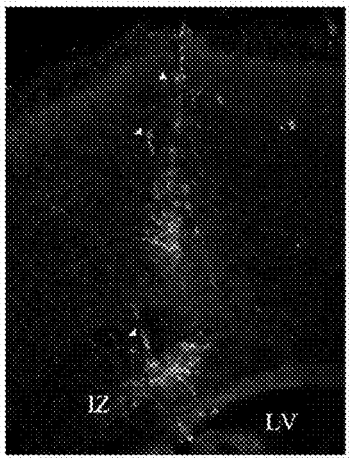
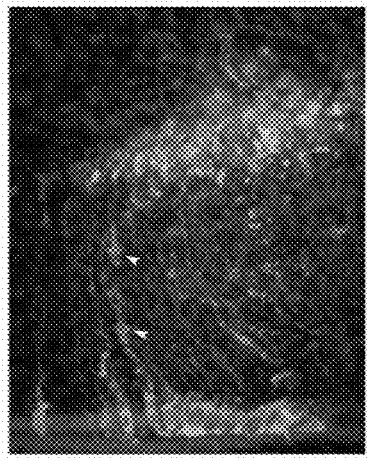
Fig. 25A Fig. 25B Fig. 25C
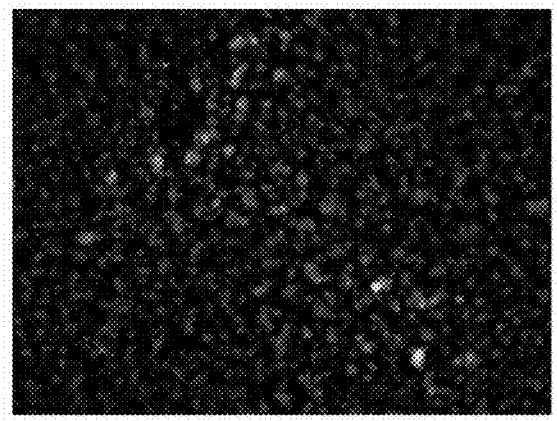
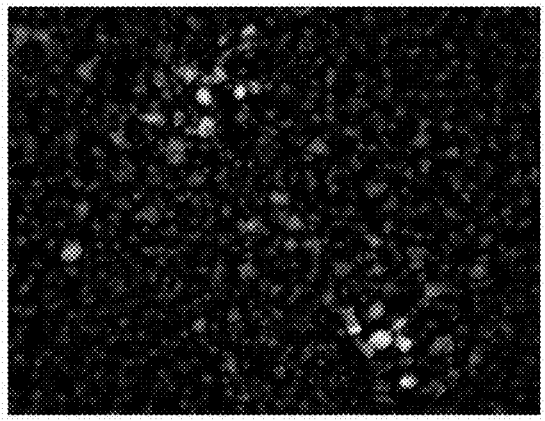
Fig. 26A Fig. 26B

ELECTROPORATION, DEVELOPMENTALLY-ACTIVATED CELLS, PLURIPOTENT-LIKE CELLS, CELL REPROGRAMMING AND REGENERATIVE MEDICINE

CROSS-REFERENCE TO RELATED APPLICATIONS

This national phase application under 35 U.S.C. § 371 is a divisional application under 35 USC § 120 of patent application Ser. No. 12/601,819 filed May 28, 2008 and a continuation under 35 USC § 120 of patent application Ser. No. 12/601,819 and of patent application Ser. No. 16/171,420 (a continuation-in-part application from Ser. Nos. 14/764,195 and 12/601,819) filed Oct. 26, 2018, of PCT/US2014/013479 filed Jan. 29, 2014, of PCT/US2014/013473 filed Jan. 29, 2014, of PCT/US2017/033234 filed 18 May 2017, of international application PCT/US2008/065007, filed May 28, 2008, of United States Patent Application 20140271923 filed Mar. 13, 2014, of U.S. Pat. Nos. 10,138,451B2, and of 9,834,750B2, and claims the benefit under 35 U.S.C. § 119 to U.S. Provisional Application Ser. No. 60/932,020, filed May 29, 2007, U.S. Provisional Application Ser. No. 60/933,133, filed Jun. 5, 2007, U.S. Provisional Application Ser. No. 60/933,670, filed Jun. 8, 2007, U.S. Provisional Application Ser. No. 61/006,449, filed Jan. 14, 2008, U.S. Provisional Application Ser. No. 61/064,761, filed Mar. 25, 2008, U.S. Provisional Application Ser. No. 61/849,588, filed on Jan. 30, 2013, and U.S. Provisional Application Ser. No. 61/849,589, filed on Jan. 30, 2013, U.S. Provisional Application Ser. No. 62/390,081, filed 18 Mar. 2016, U.S. Provisional Application Ser. No. 62/390,438, filed 29 Mar. 2016, U.S. Provisional Application Ser. No. 62/918,459, filed Jan. 31, 2019 and U.S. Provisional Application Ser. No. 62/918,462, filed Jan. 31, 2019, and US2019/0256813, filed Oct. 26, 2018 the entire contents of which applications are hereby incorporated by reference in their entireties.

STATEMENT REGARDING SEQUENCE LISTING

The Sequence Listing associated with this application is provided in text format in lieu of a paper copy, and is hereby incorporated by reference into the specification. The name of the text file containing the Sequence Listing is SEQUENCE-LISTING.txt. The text file is 654,169 bytes, was created on Sep. 24, 2019, and is being submitted electronically via EFS-Web.

FIELD OF THE INVENTION

This invention relates to equipment and methods for electroporation and developmental cell activation using electroporation and other methods.

BACKGROUND OF THE INVENTION

U.S. Pat. No. 3,598,119 discloses an injection needle that may be guided through an inner lumen of a catheter and a bladder at the distal end of a catheter—that may be inflated through another lumen so as to fix the position of the point of the needle.

U.S. Pat. No. 4,578,061 discloses a catheter featuring an injection needle which is longitudinally movable beyond the distal end of the catheter. A dual chamber system provides for movement of a plunger to extend the injection needle and apply a dose of injectant.

U.S. Pat. No. 4,578,061 discloses an injection catheter having a longitudinally movable needle which may be extended through a lumen and out of the side wall of the catheter for injecting—a blood vessel. The needle is normally retracted into the device—in preparation for deployment.

U.S. Pat. No. 5,244,460 is directed toward a method for inserting a catheter into a coronary artery and injecting into the target tissue, organ or cavity a blood vessel growth promoting peptide via the port of the catheter.

U.S. Pat. No. 5,419,777 is directed toward an injection needle which protrudes laterally through the side walls of the distal end of the catheter.

U.S. Pat. No. 5,431,168 discloses a steerable catheter which includes a puller wire for controlling the distal end of the catheter from a control handle mounted proximally.

U.S. patent application Ser. No. 09/019,453-discloses an injection catheter system for infusing a diagnostic or therapeutic agent into the wall of an organ which includes an electromagnetic sensor disposed within the distal end of the catheter.

The transcendent challenge for medicine in the 21st century will be replacing damaged, worn-out or genetically-compromised cells. Transcription factors, small RNAs and other cell fate determinants play a vital role in regulating gene expression. It is the particular complement of transcription factors and regulating RNA sequences within an individual cell that determine which cellular programs are active and which are turned off. In this capacity transcription factors, small RNAs and other cell fate determinants play a decisive role in determining and maintaining cellular identity, as well as determining cellular vulnerability.

SUMMARY OF THE INVENTION

The present invention relates to equipment and apparatuses and methods suitable for use in electroporation, especially i. electroporation producing developmental activation in a cell leading to repair or renewal, treatment, genetic correction, etc. of a tissue or organ, and especially ii. electroporation wherein the transfectant is a peptide, protein, nucleic acid, dye or chemical compound. Said transfectants may be either natural or synthetic.

BRIEF DESCRIPTION OF THE DRAWINGS

The patent or application file contains at least one drawing executed in color. Copies of this patent or patent application publication with color drawing(s) will be provided by the Office upon request and payment of the necessary fee.

FIGS. 2B, 2C illustrate distal ends of catheters suitable for in vivo electroporation, including retractable needle with co-axial electrodes and circular electrode array circumscribing a retractable injection needle.

FIG. 17A illustrates that successful construction of the pLenti6-MSGW/EmGFP-Bsd/EF1a/miR-decoy vector was confirmed by Restriction Digestion.

FIGS. 17B-17C illustrate successful transfection for preparing a viral stock as confirmed by visualizing syncitia formation at 72 hours (FIG. 17B) versus control (FIG. 17C) 293FT cells.

FIGS. 21A-21F illustrate that following in vivo injection of the HIV-EGFP-Numblike transfectant into the lateral ventricle and subsequent electroporation, embryonic (E)15 cells exited the germinal zone, express neuronal Hu C/D, and migrated radially.

FIGS. 22A-22F illustrate that following in vivo injection of the HIV-EGFP-Numblike transfectant into the lateral ventricle and subsequent electroporation, cortical ventricular zone cells migrate, express beta-tubulin, and differentiate into neurons.

FIGS. 23A-23C illustrate that electroporation of mouse ventricular zone cells at P0 with HIV-EGFP Numblike versus HIV-EGFP control vector shows cells with divergent cell morphologies (neurons and radial glia)-evidence that numblike acts as a cell fate determinant.

FIGS. 24A, 24B illustrate that intraventricular injection of the HIV-EGFP-Numblike transfectant followed by in vivo electroporation upregulates Numb expression.

FIGS. 25A-25C illustrate that in vivo injection of the HIV-EGFP-Numb$^{PTB-/PRR-}$ transfectant followed by electroporation promotes migration and neuronal differentiation.

FIGS. 26A-26H illustrate that transiently expressed EGFP does not correlate with GLAST protein, a marker of radial glia, but strongly correlates with Numb, TUJ, and DCX markers of neuronal differentiation following HIV-EGFP-Numblike injection and electroporation, in vivo.

Figure 1A:
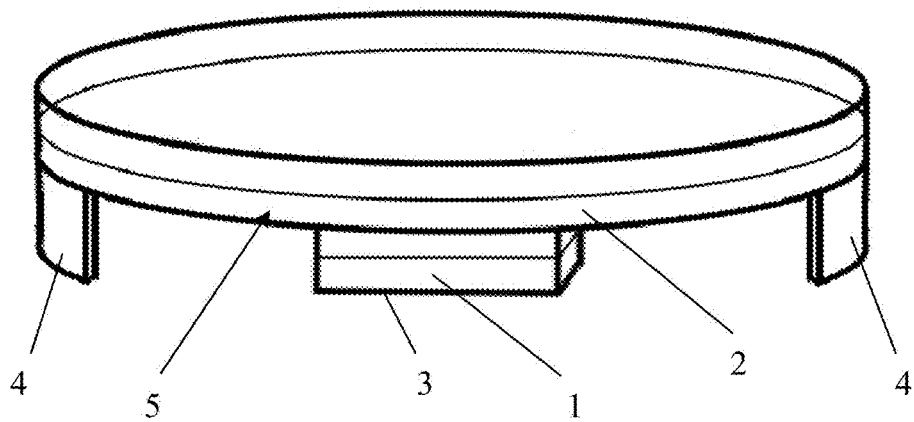
FIGS. 1A-1D illustrate cell culture dishes with reservoirs for electroporation.

Reference signs on the drawings denote the following: 1—the volume of media contained in the reservoir portion; 2—the volume of media contained in the cell culture dish overall; 3—reservoir; 4—additional "feet" or "skirt"; 5—inspection planes; 6—electrode contact; 7—catheter; 8—electrode; 9—needle; 10—plastic flask; 11—cap; 12—exposition/visualisation plane; 13—funnel; 14—electrode plates; w—width.

DETAILED DESCRIPTION

The electroporation cathether of the present invention is, in some embodiments, characterized by extendable and retractable needle suitable for injection of an agent or transfectant into the target tissue, organ or cavity tissue.

In some embodiments, the electroporation catheter further comprises a flexible tubing having proximal and distal ends and at least one lumen.

The needle of the present invention may be of any suitable medical grade construction. The needle, which in some embodiment may double as electrode, will be electrically isolated from other electrodes and their lead wires.

In some embodiments, the retractable needle extends beyond the distal end of electrode catheter tubing during injection.

In some embodiments, the needle is connected to a water-tight tube which is connected proximally to an injection controller.

In some embodiments, the injection controller is a syringe.

In some embodiments, the injection controller is a bladder.

In some embodiments, the injection controller is a mechanical pump allowing finrly-controlled and/or programmed control of the injection rate.

In some embodiments, a radiologically detectable tracer or marker is injected via the needle along with a transfectant of other agent to facilitate monitoring of successful injection and electroporation.

The needle may be of any size deemed suitable for practice of the invention by the medical interventionalist skilled in the art.

In some embodiments, the needle features multiple opening through which a transfectant or other agent may be injected.

In some embodiments, wherein the needle may double as an electrode, it is further connected to a lead wire.

In some embodiments, the injection needle may function as an electroporation electrode in combination with a second coaxially located electrode.

In some embodiments, the injection needle may function as an electroporation electrode in combination with multiple coaxially located electrodes.

In some embodiments, the injection needle may function as an electroporation electrode in combination with a loop electrode, and/or in combination with a circular array of electrodes.

In some embodiments, the injection needle may function as an electroporation electrode in combination with a circular array of needle electrodes.

In some embodiments, the injection needle does not double/function as an electroporation electrode, and, instead, coaxially located electrodes perform the electrode function.

In some embodiments, the injection needle does not double/function as an electroporation electrode, and, instead, a loop electrode, alone or in combination with coaxially located electrodes, performs the electrode function.

In some embodiments, the injection needle does not double/function as an electroporation electrode, and, instead, the electrodes of a circular array perform the electrode function.

In some embodiments, the electrodes of the electroporation catheter are retractable electrodes.

In some embodiments, the retractable electrodes may be extended beyond the distal end of catheter during electroporation.

In some embodiments, the electrodes are extended to prior to injection to ascertain the catheter is correctly positioned, and may be used to detect a change in impedance.

In some embodiments, the electrodes and/or needle doubling as an electrode may further be used to detect and/or map electrical activity in a tissue, before injection of an agent or transfectant and electroporation, or after injection or after electroporation.

In preferred embodiments, the electrodes and/or needle doubling as an electrode are connected electrically to an electrical pulse generator and power supply.

In some embodiments, the entire catheter system of the present invention is connected to a computer interface and/or computer by which the system is monitored and controlled.

In some embodiments, the electrodes and/or needle doubling as an electrode may be used to perform irreversible electroporation.

In some embodiments, a needle hand control is provided at the proximal end of the catheter.

In some embodiments, injection needle system extends from the distal end section, through the catheter tubing to a needle controller.

In some embodiments, the injection needle can translocate so that its distal end can extend under the influence of the needle hand control.

In some embodiments, electrodes are mounted on the distal end of the catheter as coaxially positioned electrodes, loop electrode(s) and/or circular electrodes.

In some embodiments, multiple electrodes are mounted on the distal end of the catheter as a circular electrode array.

In some embodiments, an electrode lead wire is electrically connected to the injection needle and to a suitable monitoring apparatus, an electrical pulse generator and a power source.

In some embodiments, the invention is directed to a method for introducing an agent, especially a therapeutic, drug, transfectant or DAdC population, into the tissue of a patient.

In some embodiments, the method comprises introducing the distal end of a catheter into or through the patient's body, vasculature, or orifice to reach the target tissue or space, wherein the injection needle is then extended beyond the distal end of the end section and a useful agent, especially a therapeutic, drug, transfectant or developmentally activate cell population, is then injected into the tissue, organ or cavity, optionally followed by reversible electroporation.

In some embodiments, the method comprises introducing the distal end of a catheter into or through the patient's body, vasculature, or orifice to reach the target tissue or space, wherein the electrodes and/or needle doubling as an electrode are used to perform electroporation.

In some embodiments, the method comprises introducing the distal end of a catheter into or through the patient's body, vasculature, or orifice to reach the target tissue or space, wherein the electrodes and/or needle doubling as an electrode are used to perform electroporation.

In some embodiments, the target tissue is a tissue that has suffered ischemic damage and the agent or transfectant or cells of the present invention is capable of mitigating said damage.

In some embodiments, the tissue is a tissue that is genetically compromised and the agent, transfectant or cells of the present invention is capable of mitigating said compromise.

In some embodiments, the tissue of the present invention is a tissue in need of regeneration and the agent, transfectant or cells of the present invention is capable of promoting regeneration.

In some embodiments, the target tissue is a tissue in need of repair and the agent, transfectant or cells of the present invention is capable of promoting said repair.

In some embodiments, the target tissue is in need of differentiated cellular elements and the agent, transfectant or cells of the inevntion is capable of promoting or providing said elements.

In some embodiments, the tissue of the present invention is a tissue featuring abnormal growth and/or proliferation (e.g. cancer) and the agent or transfectant, or cells of the inevntion is capable of reducing or eliminating said abnormal growth and/or proliferation.

In some embodiments, the target tissue hypoplastic and the agent, transfectant, or cells of the present invention is capable of promoting growth and/or proliferation.

In some embodiments, the agent or transfectant is a protein or nucleic acid and transfection is mediated by nanoparticle and/or a transfection mediating reagent, named herein.

In some embodiments, the agent or transfectant is a chemical compound or extract.

In some embodiments, a tissue is injected with a developmentally activate cell population, and electroporation is not applied.

The current invention, therefore, provides a catheter suitable for use for injection of an agent, especially a therapeutic, drug, transfectant or cell population of the present inevntion, into a target tissue, organ or cavity—with or without electroporation (EP). In some embodiments, in vivo, irreversible electroporation is performed after injection of an agent or transfectant.

In some embodiment, the catheter of the present invention comprises an catheter tubing having proximal and distal ends, an end section at the distal end of the catheter tubing, and a needle hand control and deflection controller proximal the catheter tubing.

In some embodiments, the tubing may be of any suitable construction and material so long as the construction and material provide for one or more flexible lumen.

In some embodiments, the tubing may be of any suitable construction and material providing for one or more substantially, non-compressible lumen.

In some embodiments, polyurethane, polyether ether ketone, or nylon forms the outer wall.

In some embodiments, the outer wall may further comprise a mesh of stainless steel.

In some embodiments, the catheter's outer diameter no more than 8 French.

The outer diameter of the catheter's end section is also preferably no greater than 8 French.

In some embodiments, the catheter has an inner stiffening tube made of any suitable material.

In one embodiment, the inner stiffening tube is constructed from polyimide.

In a preferred embodiment, the catheter is compatible with a conventional guide sheath.

In some embodiments, the catheter features a compression coil and puller wire assembly.

In some embodiments, one or more coaxial electrodes are mounted directly to the distal end of the flexible tubing of the end section.

In some embodiments, one or more ring electrode is mounted to the end section of the catheter and connected to lead wires.

In some embodiments, the catheter end section comprises a deflectable segment and an adjustable circle or loop housing an electrode array of variable number.

In some embodiments, the catheter electrodes are irrigated electrodes and perfusion fluid channels are incorporated in the main body portion, and the control handle.

In some embodiments, a compression coil surrounds the puller wire from the proximal end of the catheter tubing to the proximal end of the end section.

In some embodiments, the compression coil is made of stainless steel.

The ability to derive proliferating, self-renewing, multipotent and pluripotent cell population(s) from otherwise non-pluripotent, non-self renewing cells may have significant positive implications for all fields utilizing cellular therapies. These fields include bone marrow transplantation, transfusion medicine, and gene therapy and enable the production of patient-specific stem cells and other desired cell types. Likewise, the ability to initiate differentiation of cells into neural, muscle, and various other desirable cell populations is and will also be of significant value to medicine and commercial processes involving animals. Accordingly, the present invention provides methods for genetic production and uses of multipotent cell populations, pluripotent cell populations, neuronal cell populations, muscle cell populations, and other desired cell populations such as, for example, HIV resistant cell populations.

The invention may be used with any suitable cells, including vertebrate cells, and including fish, mammalian, avian, amphibian, and reptilian cells.

A theoretical basis for the embodiments of the invention is described herein, however, this discussion is not in any way to be considered as binding or limiting on the present invention. Those of skill in the art will understand that the various embodiments of the invention may be practiced regardless of the model used to describe the theoretical underpinnings.

All patents, patent applications, and publications cited in this application are hereby incorporated by reference herein in their entireties.

The present invention relates to equipment and apparatuses suitable for use in electroporation, especially electroporation producing developmental activation in a cell, and especially protein electroporation producing developmental activation in a cell.

The current invention teaches electroporation related equipment for electroporating cells ex vivo, in vitro, or in a tissue or organ in vivo.

In one part, the present invention teaches a catheter for infusing various agents, e.g. therapeutic or diagnostic agents, into a tissue or an organ, wherein the catheter comprises an injection needle that, in some embodiments, may also serve as an electrode for electroporation, including for protein electroporation.

It is a proposition of the present invention that the efficient introduction or overexpression of nucleic acids or proteins corresponding to specific transcription factors and small RNAs, alone or in combination with other cell fate determinants (e.g. notch, numb, numblike, various small RNAs, and various specific aptamers, and other cell fate determinants known to the art), enables the interconversion of what have been considered transitory (multipotent, pluripotent, and/or self-renewing) or fixed (differentiated or somatic) cellular phenotypes. The ability to reliably induce developmental activation, phenotypic conversion, or cellular reprogramming allows the production of stem-like cells, replacement cells, tissues, and organs that match individual patients or subjects. In conjunction with gene therapy techniques and cell culture techniques, cell type interconversion also provides for the production of disease-resistant and genetically-repaired cells that are suitable for transplantation.

The current invention teaches that it is the particular complement of transcription factors within an individual cell that determines which cellular programs are active and which are turned off. In this capacity transcription factors play a decisive role in determining and maintaining cellular identity, as well as determining cellular vulnerability.

It is a further teaching and proposition of the present invention that the efficient introduction or overexpression of specific transcription factors, alone or in combination with other cell fate determinants, such as regulatory RNAs (e.g. small RNAs) enables the production of transitory (multipotent, pluripotent, and/or self-renewing) or fixed (differentiated or somatic) cellular phenotypes. The ability to reliably developmentally activate, induce or reprogram cells using cell fate determinants allows the production of stem cells, replacement cells, tissues, and organs that match individual patients or subjects. In conjunction with gene therapy techniques and cell culture techniques, cell type interconversion also provides for the production of disease-resistant and genetically-repaired cells that are suitable for transplantation.

It is an object of this invention to provide various manners of generating developmentally-activated cells (DAdC)-proliferating, self-renewing, multipotent, pluripotent and/or "pluripotent-like" cell population(s), as well as other desirable cell populations, from either dividing or non-dividing cells without requisite use of oncogenes. Differentiating cell populations (aka differentiating somatic cell populations) comprise cells expressing some, but not all markers associated with specific cell type categorization. It is disclosed herein that appropriate cell fate determinants (protein or nucleic acid) in combination with other transgenes (or their corresponding proteins), especially transcription factors and small RNAs, enables the production of dividing, pluripotent, or pluripotent-like cell populations or differentiating cell populations. Moreover, the methods (including the vectors) of the present invention may be used to produce genetic modification (e.g. expression of gene products deficient in the patient) and to transiently or permanently induce proliferation, self-renewal, or stem/progenitor cell behavior in endogenous cells in vivo, particularly those cells found in tissues which normally do not show or no longer show such behavior. Finally, the methods (and the vectors) of the present invention may be used block proliferation, self-renewal, or stem/progenitor cell behavior in cells aberrantly displaying such behavior (e.g. cancer cells).

Likewise, the current invention provides for production, using various, including commercially available means, of all manner of vectors known to the art, such that they comprise and allow expression of one or more members of the transcription factors and other cell fate determinants described herein for activating, inducing or reprogramming a cell to a desired type.

It is also an object of the present invention to provide therapeutic vectors and cells capable of expressing beneficial sequences (such as small RNAs or synthetic oligonucleotide sequences, or sequences coding for proteins) predicted to attenuate disease processes. For example, the current invention discloses the use of synthetic oligonucleotides to reduce gene expression critical HIV and other immunodeficiency virus infection, propagation and spread.

Equipment and Apparatuses suitable for use in Electroporation

The present invention relates in part to equipment and apparatuses suitable for use in electroporation, especially electroporation producing developmental activation in a cell, or that may be used in conjunction with cells activated developmentally according to the methods described herein.

An electroporator uses a high-voltage electrical discharge to introduce a transfectant or transfectants into a cell. This method, commonly referred to as electroporation, typically involves suspending selected, target cells in a phosphate-buffered saline (PBS) solution to which, a nucleic acid, protein, dye, or other transfectant is also added, Electroporation can be used for both transient and stable transfection. Most commonly, the cell and transfectant suspension are transferred to an electroporation cuvette. Connected to a power supply, an electrical pulse generator subjects the cells in the cuvette to a high-voltage electrical pulse of defined magnitude and length. The high-voltage pulses cause the various membranes of the cell to lose their normal integrity to take up and/or overexpress the introduced, exogenous transfectant. The electric potential across the cell membrane drives charged molecules across the membrane through the temporary pores induced in the cell membrane, in a manner similar to electrophoresis (Shigekawa and Dower, 1988). Following electroporation, the cells are often allowed to recover briefly before they are placed in normal (non-selecting) cell growth medium. Factors that can be varied to optimize electroporation effectiveness are discussed in introduction to Section I, and protein expression strategies are discussed in Chapter 16 of Curr Protoc Mol Biol. 2003 May; doi:10.1002/0471142727.mb0903s62.

The amount of voltage and current required in transfection procedures depends upon the cell type and the nature of the transfectant, A transfection high-voltage controller is taught by U.S. Pat. No. 4,750,100. The commonly employed practice of transferring cells from a first cell culture apparatus to a cuvette and then to another cell culture apparatus is attendant with contamination and infectious risks. The Neon® Transfection System is a second-generation transfection system that uses an electronic pipette as an electroporation chamber, but Neon still requires that the electroporation procedure be carried out within a sterile environment, e.g. a restrictive, cell culture hood, and does not completely eliminate the transfer related contamination and infectious risks. In contrast, the present invention provides a combined electroporation chamber/cell culture apparatus allowing electroporation and cell culture to be accomplished in the same cell culture apparatus-obviating the need for transfer from an electroporation chamber to a separate cell culture apparatus.

The novel culturing apparatus (assembly) of the present invention may be termed a cell culture dish. More particularly, the present invention is a "combined cell culture dish" or "dish-in-dish" apparatus comprising at least one smaller cell culture dish fixedly positioned within a larger cell culture dish, and the number of such fixated cell culture dishes can include a multiple number of fixated cell culture compartments within one another, either concentric or eccentric, in any number of geometric shapes, and without limitation to the number of compartments included. An alternate embodiment of this invention can include a plurality of cell culture dishes juxtaposed side-by-side having common interior well walls, and the well walls may or may not be different in height depending on the application. The combined cell culture dish differs from the prior art, in part, because the walls of said combined compartments may be of different heights and made from any combination of transparent and non-transparent materials that will allow juxtaposing cultures to grow simultaneously.

In some embodiments, the cell culture compartment communicating with a reservoir suitable for electroporation is a cell culture bag.

In some embodiments, the cell culture compartment communicating with a reservoir suitable for electroporation is a bioreactor of variable dimensions and shapes.

Accordingly, one skilled in the art will recognize that the cell culture compartment may be of any construction, shape or size, so long as it may be made to communicate with a second compartment of variable size and construction suitable for electroporation.

The combined cell culture/electroporation apparatus of the present invention may or may not be fitted with single or multiple covers and may or may not be stacked. A particular embodiment of the arrangement described herein comprises one or more smaller dish or compartment (aka reservoir or reservoirs) located inferiorly, within, or adjacent to a larger cell culture dish with which it can communicate, and wherein said smaller dish (which may have dimensions akin to those of standard electroporation cuvettes) comprises electrodes or electrode plates that enable electroporation. In some embodiments, a wall of low height (aka a lip) will separate the smaller dish/compartment (e.g. the cuvette-like reservoir) from the larger dish/compartment. The low wall or lip and/or funnel demarcates and surrounds the reservoir while also demarcating the space by which these two cell cultures may communicate (e.g. if a sufficient volume of medium is added and the cuvette-like reservoir overflows). Such an arrangement of compartments allows cells to undergo electroporation and incubate in a single cell culture apparatus-obviating the need to transfer cells from a first apparatus (e.g., a first cell culture dish) to a second apparatus (e.g., an electroporation cuvette), as well as obviating the need to transfer the cells from the second electroporation chamber apparatus to a third apparatus (e.g., a second cell culture dish) for further incubation; accordingly, this particular arrangement provides a "closed system" that reduces labor, costs of materials, and infectious/contamination risks.

The main compartment and the reservoir may be of various sizes and dimensions.

In some embodiments, when the design features a flask-like compartment, the flask like compartment will preferably approximate standard flask dimensions while the reservoir may approximate standard electroporation cuvette sizes.

In one embodiment, the flask, plate, dish, bag, etc. cell compartment takes the width of an embedded cuvette-sized reservoir.

In one embodiment, the reservoirs are detachable and snap onto or slide into the larger main dish, plate or flask.

Likewise, the spatial relationship between the multiple compartments taught herein allows the electroporation procedure to be performed in a non-sterile environment, e.g. outside of the tissue culture hood, at the bench. Currently, the size of a tissue culture hood limits the size of the electroporation apparatus. When performed outside of the tissue culture hood using the cell culture dishes, plates and flasks equipped with one or more electroporation reservoirs, as taught herein, the electroporation apparatus may be of unlimited size and can be used to perform electroporation of multiple (up to hundreds or thousands of) cell cultures simultaneously, thereby enabling higher throughput. Accordingly, a parallel array of electrodes suitable for high throughput, parallel electroporation is also described herein. Such an array may take the form of a slot or slots containing multiple electrode pairs spaced at distances accommodating the dimensions and spacings of the reservoirs, or a block with multiple wells, each well containing one or more electrode pairs and having dimensions accommodating the one or more reservoir portions of the "reservoir-in-dish" or "reservoir in flask", etc., cell culture dishes, plates, flasks, bags, bioreactors, etc.

In general, the cell culture/electroporation apparatus of the present invention comprises two or more compartments which create a central compartment and one or more peripheral compartments which surround the central compartment. Said central and peripheral compartments may take the form of any shape, or any geometrical realtionship including, but not limited to cylindrical, square, pentagonal, or hexagonal. The material used to construct said petri dish may include, but may not be limited to any non media-permeable form of glass, plastic or metal or combination thereof, which will sustain culture growth and permit observation and recording of said culture growth, differentiation and/or signal transduction. Separated areas created by utilizing the central compartment and one or more peripheral compartments may be geometrically concentric or eccentric.

The cell culture/electroporation apparatus of the present invention may comprise one or more compartments within a compartment or may be constructed of a single compartment with a flat well bottom having one or more sets of walls that extend from said well bottom forming one or more separate enclosures having the same geometric shape or a variety of geometric shapes.

In some embodiments, the walls of the combined cell culture/electroporation apparatus are arranged in a manner that allows communication of cells and/or media between and amongst the separate compartments when a sufficient volume of medium is present. For example, one compartment may be filled with cells and/or medium to a certain height, wherein the medium and/or cells remain restricted, confined or localized to a first compartment, and wherein further addition of cells and/or medium allows the contents of the first compartment to ascend above or spill over walls or lips demarcating one compartment from a second compartment, or to spread into a second compartment communicating with the first.

Definitions

As discussed herein, "DNA" refers to deoxyribonucleic acid and "RNA" refers to ribonucleic acid. As discussed herein, "cDNA" refers to complementary DNA; "mRNA" refers to messenger RNA; "siRNA" refers to small interfering RNA; "shRNA" refers to small hairpin RNA; "miRNA" refers to microRNA, such as single-stranded RNA molecules, typically about 20-30 nucleotides in length, which may regulate gene expression; "decoy" and "decoy RNA" and "RNA decoy" refer to an RNA molecule that mimics the natural binding domain for a ligand.

As used herein, the meaning of the term "ameliorating" includes lessening an effect, or reducing damage, or minimizing the effect or impact of an action, activity, or function, and includes, for example, lessening the deleterious effects of a disease or condition.

As used herein, the meaning of the term "retarding" includes slowing or lessening the progress of an effect or action, and includes, e.g., slowing the progress of disease, slowing the rate of infection, or otherwise slowing or reducing the advance or progress of a disease or condition.

As used herein, an "inducing agent" is an agent that aids or is alone effective to promote an action. For example, an exogenous agent that affects a promoter, e.g., by initiating or enhancing its activity, and so affects expression of a gene under control of the promoter, may be termed an inducing agent. For example, tetracycline may be used as an inducing agent; and doxycycline may be used as an inducing agent.

A nucleic acid sequence (e.g., a nucleic acid seqeuence encoding a polypeptide) is termed "operably linked" to another nucleic acid sequence (e.g., a promoter) when the first nucleic acid sequence is placed in a functional relationship with the second nuceleic acid sequence. For example, a promoter is operably linked to a coding sequence if the promoter affects the transcription or expression of the coding sequence. As used herein, the term "driven by" refers to a gene or coding sequence that is operably linked to a promoter sequence, and that the promoter sequence affects the transcription or expression of the coding sequence.

As used herein, a "marker" is a molecule that is detectable, or codes for a detectable molecule, or acts on other molecules so that the presence of the marker is detectable. A "marker protein" or "marker polypeptide" is a protein or polypeptide that is detectable in a laboratory or clinical environment, and, in embodiments, may be detectable by eye. A "marker gene" encodes a marker protein or marker polypeptide.

As used herein, "HIV" refers to human immunodeficiency virus, and includes variants such as, e.g., HIV-1, HIV-2. Other immunodeficiency viruses include simian immunodeficiency virus (SIV) and feline immunodeficiency virus (Hy). Enzymes related to HIV may be termed "HIV enzymes" and include, for example, integrase, protease, reverse transcriptase, and transactivating regulatory protein (TAT).

Infection by HIV is believed to involve receptors termed "HIV receptors." There may be multiple such receptors, some of which may be termed "HIV co-receptors." As discussed herein, HIV co-receptors include CXCR4 and CCR5.

Developmentally-active cells (DAC), as defined herein, represent a broad category of cells that are either i. "transitory-type cells" typically showing high potency, such as embryonic stem (ES) cells, very small embryonic-like (VSEL) cells, pluripotent stem cells, multipotent stem/progenitor cells), or ii. "fixed-type" cell types, which typically have low or limited potency, (e.g. differentiating somatic cell types capable of further differentiation and/or integration in vivo—usually over the course of an organism's development).

While "transitory" DAC tend, in nature, to divide and/or show self-renewal, "fixed" DAC are more often post-mitotic and usually do not self-renew. Instead, fixed DAC typically show the emergence of some characteristics associated with a terminally-differentiated cell of its type.

Nevertheless, both "transitory" and "fixed" cells have uses and potential uses in medicine (especially regenerative medicine, transplantation medicine, veterinary medicine, animal husbandry, drug-discovery, drug-testing, gene therapy, tissue-engineering, organ production, and biological modeling), laboratory-based food production, and various other industries.

As a category, developmentally-active cells (DAC) include cells that inherently show features of developmentally active cells, as well as cells that have been "activated", aka "made", "forced", "induced", or "reprogrammed" to acquire such characteristics; this latter subset of developmentally active cells herein defined as, "developmentally-activated cells (DAdC)".

Writing with respect to with respect to B cells and T cells of the immune system, Kolanus et al., (1992) observed that a "developmentally activated cell state" results from "a change in transcriptional potential". Likewise, as used herein, "developmentally-activated cells" (DAdC) include cells which some skilled in the art term, "reprogrammed cells", "partially-reprogrammed cells", "induced pluripotent cells", "directly reprogrammed cells", "indirectly-reprogrammed cells", etc., e.g. induced pluripotent cells, induced multipotent cells, induced hematopoietic stem/progenitor cells, induced neurons, induced cardiac cells, induced skeletal muscle cells, induced cartilage cells, induced hematopoietic cells, induced liver cells, induced pancreatic beta cells, etc.)—as such cells show a change in transcriptional potential relative to untreated cells.

As used herein, terms of art, such as "pluripotent", "multipotent", "self-renewing", "differentiating", "cardiac", "muscle", "neuron", "progenitor", "stem cell", "osteoblast", "chondrocyte", etc. are understood to refer either to i. cells produced in nature (natural cells) of a type, or to ii. like cells produced through the methods described herein-cells displaying some, but not necessarily all, features marking the natural cells denoted by these terms.

For example, as used herein, a "pluripotent cell" is one capable of forming embryoid in vitro and that expresses some markers of pluripotency, however it need not be capable of forming teratomas in vivo; accordingly, as used herein, "pluripotent cells" need not meet all criteria for pluripotency commonly applied by some skilled in the art.

Conversely, some cells recognized as "pluripotent" by those skilled in the art are considered herein to represent inherently, developmentally-active cell types, e.g. embryonic stem cells (ES) cells, Very Small Embryonic-Like (VSEL) stem cells, mouse embryonic stem cells (mES), etc. In regard to such cells, Kim et al. (2014), write, "Pluripotent stem cells (PSCs) have been considered as the most important cells in regenerative medicine as they are able to differentiate into all types of cells in the human body. PSCs have been established from several sources of embryo tissue or by reprogramming of terminally differentiated adult tissue by transduction of so-called Yamanaka factors (Oct4, Sox2, Klf4, and cMyc). Interestingly, accumuating evidence has demonstrated the residence of PSCs in adult tissue and with the ability to differentiate into multiple types of tissue-committed stem cells (TCSCs). We also recently demonstrated that a population of pluripotent Oct4(+), SSEA-1(+), Sca-1(+), Lin(−), CD45(−) very small embryonic-like stem cells (VSELs) resides in the adult murine bone marrow (BM) and in other murine tissue.

These very small (~3-6 μm) cells express pluripotent markers such as Oct4, Nanog, and SSEA-1. VSELs could be specified into several tissue-residing TCSCs in response to tissue/organ injury, and thus suggesting that these cells have a physiological role in the rejuvenation of a pool of TCSCs under steady-state conditions. In this review article, we discuss the molecular nature of the rare population of VSELs which have a crucial role in regulating the pluripotency, proliferation, differentiation, and aging of these cells (Kim Y, Jeong J, Kang H, Lim J, Heo J, Ratajczak J, Ratajczak M Z, Shin D M. The molecular nature of very small embryonic-like stem cells in adult tissues. Int J Stem Cells. 2014 November; 7(2):55-62).

It follows that the pluripotent, VSEL cells and tissue-committed stem cells TCSC's of Kim et al., represent cell types included in the category of developmentally active cells (DAC).

Pluripotent cells are most commonly defined by their ability to produce cell types reflecting all three embryonic germ layers of a developing gastrula (ectoderm, endoderm and mesoderm). This ability to form all three germ layers relates both to teratoma formation in vivo and embryoid formation in vitro. As Lin and Chen (2014) write, "Embryoid bodies (EB) are the three-dimensional aggregates formed in suspension
by pluripotent stem cells (PSC), including embryonic stem cells (ESC) and induced pluripotent stem cells (iPSC)."

Pettinato et al. (2015) further describe embryoid bodies as,

"three-dimensional (3D) hPSC [human pluripotent stem cell] aggregates that can differentiate into cells of all three germ layers (endoderm, ectoderm, and mesoderm) [3]. Many events in the in vitro lineage-specific differentiation process within the EBs recapitulate those seen in vivo in the developing embryo [6], which justifies the uses of EBs as a model system to simuate the in vivo differentiation of hPSCs under in vitro culture conditions, and mechanistically examine hPSC differentiation programs/lineage commitment during embryogenesis as an alternative to the whole embryo approach [7]. In addition, in vitro formed EBs have opened access to early precursor cell populations that are not accessible in vivo [8]. EBs have been shown to effectively initiate lineage-specific differentiation of hPSCs toward many lineages, such as cardiac [9], neural [10,11], hematopoietic [12], and pancreatic β cells [13]."

In part, the current invention is directed to the production of "transitory type" developmentally-activated cells (DAdC) that display many features associated with pluripotent, mutiptipotent, and/or self-renewing cells, e.g. the capacity to form embryoid (aka embryoid bodies) when cultured in vitro. Embryoid formation is a behavior those skilled in the art often associate exclusively with pluripotent cells.

As used herein, embryoid formation by cells "developmentally-activated" according to methods described herein indicates that these newly, developmentally-activated cells (DAdC) are at least "pluripotent-like" and "VSEL-like", if not fully pluripotent. Thus, the current invention is directed, in part, to the production of cells considered, herein, to be "pluripotent-like", "VSEL-like", "mutiptipotent-like", and/ or "self renewing-like" cells. In part, then, the current invention is directed, in part, to the production of cells with increased potency.

Teratomas contain cells from the three germ layers: ectoderm, mesoderm, and endoderm. Teratoma formation is, however, also associated with carcinogenicity. Some skilled in the art may consider that a cell cannot be termed a "pluripotent" cell unless it forms a teratoma when injected in vivo, even if this tendency to tumorigenesis is considered highly undesirable in cells intended for clinical use, especially in regenerative medicine, The developmentally-activated cells produced according to the methods taught herein need not form teratomas in order to meet the criteria of "transitory-type, developmentally activated cells (DAdC)". In contrast, the transitory DAdC produced according to the methods described herein, show many other desirable characteristics associated with pluripotency, such as small size, expression of pluripotent markers such as SSEA3/SSEA4, Oct4, Nanog, Sox2, as well as colony formation and embryoid formation, and therefore such transitory developmentally activated cells (DAdC) are termed "pluripotent" and/or "pluripotent-like", herein.

Similarly, the current invention is directed in part, to the production of "differentiating cells" (aka differentiating somatic cells, aka somatic differentiating cells) that display some, but not necessarily all, cell type specific markers associated with the desired cell type. Those skilled in the art may differ somewhat as to the criteria for defining a pluripotent cell as well as differentiating and/or differentiated cell types. As there exists no universally accepted terminology for cells induced or activated to differentiating somatic cell types, the applicants refer to various desired, differentiating cell types producible by the methods described herein as cardiac cells, neurons, chondrocytes, cartilage cells, bone cells, hepatocytes, etc.; however these terms, when used herein also refer to "cardiac-like cells", "neuron-like cells", "chondrocyte-like cells", "cartilage-like cells", "bone-like cells", "hepatocyte-like cells", etc.

Thus, the criteria for defining a desired cell type or cell potency taught herein may not coincide precisely or overlap entirely with the various criteria taught by others skilled in the art for defining a cell type or a cell potency, and the invention is therefore not bound by such various definitions. Instead, the current invention is aimed at producing cells displaying certain desirable features, characteristics and behaviors which commend them for the various and specific uses taught herein.

The induced pluripotent stem cells of Takahashi and Yamanaka, which were generated, in part, using oncogenes c-myc and klf4, were able to form teratomas when injected in vivo. Likewise, when Takahashi and Yamanaka produced embryos from these induced pluripotent stem cells, a large percentage of the resulting animals developed tumors postnatally (Takahashi and Yamanaka, 2006; Takahashi et al., 2007). Thus, teratoma formation and carcinogenicity are features associated with some iPSCs, but are features that some skilled in the art may consider undesirable with respect to providing sources of replacement cells, cells for transplantation, cells for gene therapy, cells for tissue engineering, and cells for various other clinical uses.

In contrast, the transitory, pluripotent and pluripotent-like, developmentally-activated cells (DAdC) produced according to the methods taught herein 1. display colony formation, 2. form embryoid, 3. Express various genes and proteins associated with pluripotency, 4. cluster with ES and iPS cells in hierarchical cluster analysis based on their gene expression (e.g. global gene expression profile), 5. cluster with ES and iPS cells in Principal Component Analysis (PCA) plots based on their gene expression (e.g. global gene expression profile), but 6. may fail to demonstrate the teratoma formation and the carcinogenicity frequently associated with ES cell lines and induced pluripotent stem cells.

Developmentally activated cells (DAdC), may be recognized and defined, for example, by i. gene expression analysis (e.g. by reactome overrepresentation analysis using hypergeometric distribution) that reveals overrepresentation (or enrichment) of genes associated with certain cellular pathways, especially the Cell Cycle pathways and the Developmental Biology pathways, especially the Transcriptional regulation of pluripotency sub pathway, the Axon guidance sub pathway; the Myogenesis sub pathway, the Signaling by Nodal sub pathway; the Gastrulation sub pathway; the Activation of Hox genes sub pathway, the Beta cell development sub pathway, and the Transcriptional regulation of white adipocyte differentiation sub pathway (for "transitory" type developmentally activated cells), whereas the Developmental Biology pathways, Gene Expression (Transcription) pathways, and Signal Transduction pathways are overrepresented or enriched in Reactome analyses for "fixed" type, developmentally-activated cells (DAdC).

Such enriched gene expression (as demonstrated by Reactome analysis) is consistent with the adaptability of DAdCs as a source of stem-like cells, replacement cells, cells suitable for gene therapy and tissue engineering, and cells differentiable to various types (according to the methods disclosed herein, for example, mutiptipotent and pluripotent cells.

The developmentally-activated cells (DAdC) of the present invention also typically display ii. microscopically-visible, induced changes in cell behavior related to colony formation, embryoid formation and cell size. Likewise, iii. immunohistochemistry may reveal the "transitory" developmentally activated cells as expressing multiple markers commonly associated with pluripotency, such as such as Oct4, Nanog, c-Myc, Notch, SSEA3/4; and TRA-1-81; while "fixed" type developmentally-activated cells will show some markers of differentiating or terminally differentiated cells.

As described herein, DAdC can be produced by various methods described in the parent application including the use of nucleic acids, e.g. DNA, RNA, and protein; use of miRNA aptamers, and chemical methods are also compatible with the invention.

As described in the parent application, various means of detecting, monitoring, and demonstrating induced cellular phenotype include gene reporter assays (e.g. performed with a reporter construct) wherein a reporter gene's expression (e.g. an antibiotic resistance gene or fluorescent reporter gene) is linked to the promoter of a gene upregulated in DACs (e.g. c-Myc, Nanog, Oct4, DCX, etc.), as well as other assays described herein.

However, as the term is used herein, Developmentally-activated cells or DAdC need not satisfy all criteria of pluripotency to be recognized as DAdC in the current invention, and therefore may not be pluripotent in the opinions of some skilled in the art, even if they do display desirable characteristics such as very small size, embryoid formation in vitro, and pluripotency marker expression, and other features that some skilled in the art consider tantamount to pluripotency; therefore to the extent they are similar to and display features overlapping with cells which have been commonly or unambiguously recognized as pluripotent, some DAdC may be considered herein and by some skilled in the art to be "pluripotent-like", "ES-like" or even "VSEL-like".

Accordingly, and to avoid confusion, the term, developmentally-activated cell (DAdC) is applied herein and is defined by many features these cells display morphologically, microscopically, and immuno-histologically, as well as according to their pattern of gene expression (transcriptome), their reactome, their utility, and many of their potential uses.

It should be understood that a developmentally-activated cell (DAdC) may one caused to display some features consistent with either "transitory" (pluripotent-like, multipotent-like, and/or self renewing cells) or "fixed" (somatic-like, differentiated-like or differentiating-like) cellular phenotypes, as described herein, and that the present invention enables the production and interconversion of these cells by efficient introduction or overexpression of nucleic acids or proteins corresponding to specific transcription factors, cell fate determinants, small RNAs, and/or aptamers, or by chemical and/or physical means, either in vivo or in vitro, in the presence or absence of specialized cell culture conditions.

By the same token, while terms for somatic, differentiated cells such as "cardiac cell", "neuron", "liver", "chondrocyte", "osteoblast", "T cell", "beta cell", etc. appear herein as desirable cells producible by the methods described herein, such terms are used, herein, to describe "developmentally-activated cells" (DAdC) that are similar to corresponding cells (expressing certain cell type specific markers), i.e. cardiac-like cells, neuron-like cells, liver-like cells, chondrocyte-like cells, osteoblast-like cells, T-like cells, beta-like cells, etc. Accordingly, developmentally-activated cells (DAdC) which are of the "fixed type" i. display some but usually not all markers of the desired, cell type (as assessed by Reactome, transcriptome, gene expression and/or protein expression assays), ii. are capable of survival, further differentiation and/or integration in vivo, and iii. need not meet all criteria that those skilled in the art may sometimes apply to the mature phenotype that the DAdC approximate.

Examples of published studies affirming the utility of transcription factors taught in the parent application with respect to the production of cells showing markers consistent with specific somatic phenotypes include Zhou et al. (2008); Ieda et al. (2010); Szabo et al. (2010); Vierbuchen et al. (2010); Addis et al., (2011); Huang et al., (2011); Kim et al., (2011); Pfisterer et al., (2011); Caiazzo et al. (2011); Liu et al. (2012); Outani et al., (2013); Najm et al., (2013); Mong et al., (2014); Yamamoto, et al., (2015); Xu et al., (2016); Sun et al., (2016); Vadodaria et al., (2016); Ji et al., (2016); Lee et al., (2017); Duran et al., (2018); Hirai et al., (2018); Kogut et al., (2018); McGrath et al., (2018); Stone et al., (2019); Huang et al., (2019); Lin et al., (2019); Sadahiro et al. (2019); Pereira et al., (2019a); and Kandasamy et al. (2019); it follows that the transcription factors and other cell fate determinants taught by these publications are practicable in and covered by the present invention. See also, Wazan et al. (2019), Aydin and Mazzoni (2019), and Pereira et al., (2019b), etc., for reviews.

It is taught herein that any protein, nucleic acid, or other factor known to those skilled in the art as capable of successfully activating, inducing or reprogramming a cell, either directly or indirectly (Srivastava and DeWitt, 2016; Seo et al., 2017; Fan et al., 2018; Kogut et al., 2018; McGrath et al., 2018; and Aydin and Mazzoni; 2019) may be applied by electroporation (in vivo or in vitro) to achieve superior reprogramming characterized by greater speed, greater efficiency and/or greater safety than demonstrated with previously taught methods. See www.harvardapparatus.com.

It should be understood that "transitory" type DAdC can also serve as selected cells and be converted to "fixed" DAdC according to the methods described herein, as well as according to methods published elsewhere and known to the art for converting pluripotent, multipotent, or pluripotent-like cells to various differentiated cell types.

As was the case in the parent application, while some portions of the text herein refer either only to "introduction" or only to "overexpression", it is to be understood that causing a cell to overexpress a gene has, in the context of the present invention, the same effect as introducing said gene or corresponding RNA or corresponding protein into said cell; and accordingly, the associated methods for introducing or overexpressing are used interchangeably herein.

A number of small RNAs are suitable and compatible with use in the invention and include small RNAs useful for achieving proliferating, self renewing, pluripotent, and/or pluripotent-like cells; these small RNAs include one or more selected from the miR-302/367 cluster small RNAs (miR-302a, miR-302b, miR-302c, miR-302d, miR-367), human miR-371-373 cluster small RNAs (miR-371, miR-372, miR-373), miR-17-92, C19MC cluster members, miR-133b, miR 200a, miR 23a, and miR 743b-5p, miR-187, miR-299-3p, miR-499-5p, miR-628-5p, miR-888, let-7 (let-7-b,e,f,g), miR-30 (miR-30-a-e), the mouse miR-290-295 cluster small RNAs (miR-290, miR-291a-3p, miR-291b, miR-292, miR-294, miR-295, miR-29, miR-296, miR-106a cluster, miR-93 and other pluripotency associated small RNAs known to the art, as such small RNAs can be used in conjunction with other cell fate determinants taught herein or alone. Use of RNA and proteins, which do not integrate into the host's genome, may be considered as safer approach to developmental activation/pluripotency induction/cell reprogramming, as compared to other methods that pose the risk of genomic integration. Such vectors are considered to be non-integrating and/or episomal vectors.

Accordingly, use of chemicals, compounds, extracts and drugs that induce expression of said small RNAs and other cell fate determinants is likewise suitable and compatible with the present invention-especially those chemicals, compounds, extracts and drugs taught in the priority documents associated with the present invention.

Studies Relevant to Protein Transfectants and Distinguishing the Electroporation Method Although some studies (Kim et al. 2009; Zhou et al. 2009) have reported that pluripotent cells could not be produced using a single application of cell penetrating proteins corresponding to pluripotency inducing factors, the current invention, in part, teaches the one-time application of native or recombinant protein transcription factors and/or protein cell fate determinants for the production of developmentally activated cells, including pluripotent-like cells, pluripotent cells, and/or self-renewing cells, as well as differentiating cells that express one or more cell type specific markers consistent with a desired cell type.

Based on the studies of Kim et al. 2009 and Zhou et al. 2009, many have concluded that cell reprogramming, direct reprogramming, pluripotency induction, or developmental activation cannot be achieved using proteins. They surmise or conclude further that proteins introduced to cells for that purpose are too quickly degraded within the cells, consistent with their short half-lives in cells under normal conditions.

For example, Seo et al. (2017) write, "Cell-penetrating peptide-based reprogramming might be a safe way to induce reprogramming; however, its low efficiency compared with other methods is a significant concern. The main problem is the poor stability of the recombinant proteins and following endocytic uptake".

Dey et al., (2017) make similar observations to Seo with regard to the deficiencies associated with CPP-mediated protein delivery, stating, "Presence of CPPs in reprogramming proteins is known to interfere with proper folding inside the cells and thereby decreasing the biological activity . . . endosomal entrapment is also a common barrier and is a major challenge in efficient delivery of CPP linked molecular cargo . . . . In a cell reprogramming paradigm to generate iPS cells via CPP-mediated recombinant protein transduction, reports also show that misfolded CPP-fused recombinant reprogramming proteins after endosomal release gets localized to cytoplasm and/or have a peri-nuclear region as observed in immunostained images [11,35,44,45,47-52]. Due to this, they are unable to enter the nucleus to activate downstream target genes. Nevertheless, a small amount of the biologically active recombinant transcription factors enters the nucleus and binds to its target genes to activate the cell reprogramming machinery."

On the other hand, Bekei (2013), having carefully compared the CPP-mediated protein delivery, EP-mediated protein delivery and SLO-mediated protein delivery methods), and concluded that Electroporation-mediated protein delivery is distinct from and superior to the CPP-mediated protein delivery employed by Kim et al., (2009) and Zhou et al (2009), as well as to the SLO-mediated protein delivery utilized by Taranger et al., (2005).

Bekei teaches that, "this [electroporation] method provides two main advantages over CPP- and SLO-mediated protein delivery. First, it does not require any forms of chemical modifications to proteins that are to be delivered and, second, it works without having to treat cells with potentially harmful toxins that generally lower cell viability."

Bekei, also notes that,

"CPP-mediated protein delivery approaches have to overcome significant obstacles. First, the uptake efficiencies of CPP-cargo constructs are highly dependent on the choice of the CPP sequence and on the combination of CPP/cargo proteins. Membrane compositions of targeted host cells additionally affect the individual uptake efficiencies and these properties need to be considered when devising a CPP-mediated delivery experiment. Second, even if optimal combinations of CPP/cargo sequences have been found for a particular cell line that is to be targeted, efficient release from endocytotic vesicles has to be achieved."

Consequently, in the words of Bekei, "Results demonstrate that low transduction efficiencies, high cell line dependences and vesicular-like intracellular distributions strongly limited the suitability of CPP-mediated protein delivery attempts."

In contrast, Bekei reports superior results from electroporation (EP)-mediated protein delivery, "This [protein electroporation (EP)] method proved to be superior to CPP-, and toxin-mediated delivery protocols, as outlined in the first half of the thesis. Transduction efficiencies, cell viabilities and intracellular distributions of two model proteins, human alpha Synuclein (Syn) and the B1 domain of Protein G (GB1) were comparatively analyzed in different mammalian cell types and found to be generally higher using the EP-mediated delivery approach."

Most notably, Bekei makes the critical observation that, "Although SLO- and EP-procedures yielded comparable transduction efficiencies at low applied protein concentrations, EP clearly outperformed the SLO approach at higher protein concentrations, because it enabled the linear delivery of increasing concentrations of exogenous proteins, with high correlations in intracellular cellular protein levels."

Thus, the work of Bekei (2013) makes it clear that the results of CPP-mediated protein delivery cannot be extrapolated or generally applied to other distinct, protein delivery methods, and in particular, should not be generalized to electroporation-mediated protein delivery.

Bekei further contrasts Cell Penetrating Peptides (CPP) with electroporation-mediated delivery and SLO-mediated Permeabilization, stating, "If one were to design an ideal method for intracellular sample delivery into mammalian cells, what needed this method to be able to do? First, it ought to be generally applicable to many different cell lines and proteins, and therefore, the uptake mechanism should preferably not require specific cell-surface receptor interactions of the protein that is to be delivered into these cells. Second, the method should be suitable to transduce 'native' proteins, without requirements for engineered protein tags, targeting sequences, or other chemical extensions that are necessary for cellular protein uptake. Such extensions and modifications will ultimately distort the structural and functional features of the protein. Third, the method should not require any treatment of cells with toxic compounds, which decrease cell viability and signal the activation of damage response pathways. I therefore investigated the suitability of yet a third delivery approach: protein electroporation (EP). EP fulfills many of the requirements stated above and also represents a simple and fast method that can successfully be performed by inexperienced users."

The work and writings of Bekei (2013), Seo et al. (2017) and Dey et al. (2017) are consonant and show that those skilled in the art understand that the low reprogramming efficiency reported by Kim et al. (2009) and Zhou et al. (2009) was a function of their employing the cell penetrating peptide (CPP)-protein delivery method, and that the resulting low efficiency of cell reprogramming in their studies is not necessarily generalizable to electroporation-mediated protein delivery and other protein delivery methods which are not constrained by the technical limitations of CPP, as elucidated by Seo (2017), Dey (2017) and Bekei (2013).

In contrast to the experience of Kim et al., (2009) and Zhou et al., (2009), the current invention teaches that specific proteins may be delivered to the interior of cells in amounts such that the protein(s) persist in the cells long enough to cause them to become developmentally activated, reprogrammed, induced to pluripotency, directly reprogrammed, etc. This is likely achieved, in part, through saturation of protein-degradative pathways by excess transfected factors—extending protein half-lives and the time the introduced proteins persist and have access to their binding sites and interaction partners inside the treated cells.

The present invention teaches that half-life of RNA may likewise be extended by means of electroporation, wherein larger amounts of RNA are introduced into a cell saturating its RNA degradation pathways, allowing RNA species to persist longer within the cell.

The present invention further teaches that transfectant half lives may, likewise, be extended by other transfectant delivery methods taught herein wherein such methods are utilized to introduce saturating amounts of the transfectant into a cell.

The current invention covers electroporation, and other methods known to the art, capable of delivering the desired trasfectants to the interiors of cells in amounts 1. sufficient to promote persistence of the proteins in the cells, thereby producing the desired effect, and 2. insufficient to kill the cells. Numerous such methods are known to the art and are easily adapted by (e.g. by increasing protein or nucleic acid transfectant concentration); many such methods are taught herein; they include, for example, liposomal transfection methods, fusogenic or non-fusogenic liposomes, lipofectamine, cationic lipids (e.g. Thermo Scientific Pierce Protein Transfection Reagent (formerly Pro-Ject), and use of nanocapsules or nanovaults, Previously, others have induced 293T cells to pluripotency by 1. permeabilizing the cells with streptolysin O (SLO), then 2. applying a protein extract derived from ESC or undifferentiated, human NCCIT teratocarcinoma cells (for 1 hour). Finally, 3. the pores produced by SLO are sealed by incubation (for 2 hours) in 2 mM $CaCl_2$ (Taranget et al., 2005). Critically, however, ~100,000 pluripotent ESCs or NCCIT cells was required to produce just luL of protein extract.

The present invention represents an improvement over the methods of Taranger et al., in that it 1. employs much more rapid, less labor-intensive processes and 2. does not require the availability and destruction of already pluripotent cells to induce this characteristic in others. Moreover, in embodiments involving cell permeabilization and/or cell penetration, the present invention teaches methods that are, in some instance, near instantaneous (e.g. electroporation). Likewise, none of the methods taught by the present invention require 2 hours of pore re-sealing. Indeed, when permeabilization is desirable, the permeabilization methods taught herein are faster, less tedious, and may be employed with recombinant and/or defined proteins, nucleic acids, small molecules, and/or physical means.

Accordingly, in some embodiments, the proteins introduced or overexpressed in selected cells consist of recombinant proteins or nucleic acids, rather than natural protein extracts.

Likewise, in some embodiments wherein a permeabilizer akin to SLO is used to permeabilize cells for introduction of protein, the proteins introduced following permeabilization consist of recombinant proteins.

In some embodiments wherein a permeabilizer akin to SLO is used to permeabilize cells for introduction of protein, the proteins are not derived from cell extracts.

In some embodiments wherein proteins are introduced into cells to produce developmental activation/cell reprogramming or to induce pluripotency, the proteins introduced will not comprise more than two of Oct4, Sox2, and Nanog.

In some embodiments of the present invention, when proteins are introduced into cells, the proteins do not comprise a complete cellular protein extract.

In some embodiments, when proteins are introduced into cells, the proteins do not comprise a complete cellular extract derived from a cancer cell or embryonic stem cell.

In some preferred embodiments, when large throughput is desired, the method of electroporation is large volume flow electroporation (Li et al., 2002; Craiu et al., 2008; Parham et al., 1998; Wang et al., 2009; Wang et al., 2010; Li et al., 2013; Wei et al., 2011); Kamigaki et al., 2013; and Steger et al., 2015).

The invention further covers the use of cell penetrating peptides in conjunction with electroporation or another delivery method that increases the efficiency with which the peptides enter the cell.

The present invention covers the combination of various delivery methods, such as electroporation in conjunction with liposomal protein, nucleic acid or other molecule delivery; electroporation in combination with cell penetrating peptides or other recombinant proteins; electroporation in combination with viral transduction; electroporation in combination with nanoparticle, nanotube, nanocapsule or nanovault delivery; electroporation in combination with cationic lipids; electroporation in combination with non-integrating viral vectors (e.g. integrase deficient, episomal, lentiviral vectors); cationic lipids in combination with nanoparticle, nanotube, nanocapsule or nanovault delivery; cationic lipids in combination with cell penetrating peptides, etc.

The invention further covers the use of other methods and reagents such as those described in U.S. Pat. No. 6,841,535 for the delivery of the protein(s) and other molecules taught herein.

We have successfully induced millions of cells, at high efficiencies, to change morphology, form colonies, form embryoid, express markers of pluripotency, and display reactomes consistent with developmental activation using a single application of electroporation (see Koken et al., 1994) and other methods described herein.

However, the invention in no ways precludes repeated application of proteins, nucleic acids, small RNAs or other cell fate determinants taught herein, using electroporation or sonoporation, or other methods described herein for introduction of nucleic acids or proteins.

In some preferred embodiments, in order to produce developmentally-activated cells (DAdC), nucleic acids or proteins corresponding to transcription factors, small RNAs and/or other cell fate determinants, are electroporated into selected cells using voltages ranging from 100V to 500V (preferentially ~300V) and pulses ranging from 10 to 300 pulses (preferentially 50-100 pulses), and preferably a pulse length of 5 ms with 100 ms pulse intervals. See also Koken, et al., 1994; Deora et al., 2007; Shi et al., 2018).

In one preferred embodiment, in order to produce developmentally-activated cells (DAdC), protein transcription factors and small RNAs and/or other cell fate determinants are electroporated into selected cells using pulse length of ~5 ms and pulse intervals of ~100 ms.

However, any electroporation protocol known to the art and suitable for efficiently introducing into selected cells, nucleic acids or proteins corresponding to transcription factors, small RNAs and/or other cell fate determinants, is practicable in the invention.

In one embodiment, developmentally activated cells are produced by electroporation with one or more transfectant selected from DNA, RNA, protein, small molecule, chemical, compound, extract, and/or oil.

In one embodiment, developmentally activated cells are produced by electroporation of one or more transfectant selected from DNA, RNA and/or protein corresponding to one or more transcriptions factors and/or cell fate determinants.

In one embodiment, developmentally activated cells are produced by electroporation of one or more DNA transfectant, whether plasmid DNA, vector DNA, an aptamer, a synthetic oligonucleotide, or other source of DNA encoding or inducing or promoting expression of a transcription factor and/or other cell fate determinant.

In one embodiment, developmentally activated cells are produced by electroporation of one or more RNA transfectant, whether naked RNA, an RNA virus, small RNA, miRNA, a synthetic oligonucleotide, an aptamer or other source of RNA translatable to or inducing or allowing expression of a transcription factor and/or other cell fate determinant.

In one embodiment, developmentally activated cells are produced by electroporation with one or more protein transfectant, whether a peptide, full length protein, partial protein, natural protein, native protein, synthetic protein, recombinant protein, or other source of protein acting as a transcription factor or other cell fate determinant; or inducing or allowing the expression of a transcription factor and/or other cell fate determinant.

In one embodiment, developmentally activated cells are produced by electroporation, albeit at lower efficiencies, in the absence of a DNA, RNA or protein transfectant.

In one embodiment, the one or more transfectants is derived from a subject's or a patient's own cells, tissues, fluids or body.

In one embodiment, developmentally activated cells (DAdC) are produced using sonoporation (see Delalande et al. 2015; Wang et al., 2018), gene gun (see Sanford, 1993; O'Brie, 2001; O'Brien and Lummis, 2007), or laser based transfection (see Yao et al., 2008; Kim and Eberwine, 2010; Pylaev et al., 2018), or by these and other transfection methods (see Kim and Eberwine, 2010; Parent 20192019) or their combination.

In one embodiment, developmentally activated cells (DAdC) are produced by forcing the cells through filters of progressively reduced size ultimately forcing the cells through the smallest, ~5 um filter.

In one embodiment, developmentally activated cells (DAdC) are produced by incubating the cells in plant extracts diluted 1:1000 to 1:5000 (See US20140271923; WO2017161387A1; US2019224193A1; U.S. 62/918,459; and U.S. 62/918,462).

In one embodiment, developmentally activated cells (DAdC) are produced by forcing the cells through filters of progressively reduced size eventually forcing the cells through Sum filter. In one embodiment, developmentally activated cells (DAdC) are produced by incubating the cells in plant extracts diluted 1:1000 to 1:5000 (See US20140271923; WO2017161387A1; US2019224193A1; U.S. 62/918,459; and U.S. 62/918,462).

In one embodiment, developmentally activated cells are produced by electroporation, albeit at lower efficiencies, in the absence of any transfectant other than the salts and other components of the buffer (e.g. of phosphate buffered saline).

It is the proposition of this invention that electroporation allows safer and/or faster production of developmentally activated cells, is compatible with DNA, RNA and Protein transfectants, and allows the avoidance, when desired, of integrating viruses, and/or reliance on oncogenes.

It is the proposition of this invention that electroporation allows safer and/or faster production of developmentally activated cells, is compatible with DNA, RNA and protein transfectants, and that multiple rounds of electroporation are not required to achieve the desired effect, although the invention anticipates and contemplates that some practitioners of the invention may, for example, decide to apply reprogramming factors or agents via mutipltiple rounds of electroporation.

It is the proposition of this invention that electroporation allows safer, more efficient and/or rapid production of developmentally-activated cells using protein and/or other transfectants without repeated application of reprogramming factors and without a requirement for special cell culture conditions; however the invention anticipates, contemplates and covers the use of special cell culture conditions that may further facilitate or enable the developmentally activated cells to acquire the desired cell phenotypes.

As taught herein, reprogrammed cells represent an example of developmentally-activated cells. Likewise induced pluripotent, induced mutipotent, induced self-renewing and/or induced somatic cell types (aka differentiating cells), as described herein, further represent examples of developmentally-activated cells.

It is taught herein that any protein or RNA or DNA known to those skilled in the art as capable of successfully reprogramming a cell, either directly or indirectly reprogramming said cell, may be applied by electroporation (in vivo or in vitro) to achieve reprogramming with greater speed, greater efficiency and greater safety (Srivastava and DeWitt, 2016; Seo et al., 2017; Fan et al., 2018; Kogut et al., 2018; McGrath et al., 2018; and Aydin and Mazzoni; 2019).

In one embodiment, greater safety is realized when electroporation is utilized to produced the desired cell types, thereby enabling integrating viral vectors and/or oncogenes to be avoided.

In one embodiment, greater efficiency is realized when electroporation is utilized, as electroporation enables varying amounts of the transfectant to be delivered to the interior of the selected target cells in a controlled and linear fashion.

In one embodiment, greater speed is realized when electroporation is utilized, as electroporation enables rapid changes in cell morphology and size to be observed within 24 hours of treatment. As discussed in the parent application, there are many protocols known to those skilled in the art for successful electroporation of a wide variety of transfectants including DNA, RNA, and protein. Koken et al., 1994 demonstrated successful protein electroporation almost thirty years ago. Like Koken et al., we applied electroporation at 300V to enable protein electroporation of selected cells, nevertheless, various voltages, pulse lengths and pulse intervals are suitable for practicing the invention. See, for example, the large number of protocols for electroporation of various transfectants into various cell types archived at www.btxonline.com.

Delivery of the transfectant increases predictably with pulse number.

All settings that we tried were successful in delivering protein to the interior of the cells selected. FITC-conjugated albumin served as a test transfectant and offered an excellent means of immediately visualizing the extent of protein delivery to the interior of the cells in conjunction with various electroporation parameters.

After electroporation, cells were collected, washed and resuspended in PBS or medium for visualization using fluorescent microscopy. With increasing pulse number ranging from 10 pulses to more than 100 pulses, the brightness of the cells increased as well. However, we noted no obvious loss of cell viability, even with >100 pulses.

Efficient Activation/Induction/Reprogramming was observed using 30-70 pulses: thus 70 pulses was used in the majority of experiments. However, a widely varying number of pulses could be used to achieve the claimed effect.

Note that the invention may be practiced with any electroporation parameters known to the art so long as they provide for sufficient delivery of the transfectants to achieve the claimed effect at a desirable efficiency.

In one preferred embodiment, the voltage is 300V, the pulse length is 5 ms, the pulse interval is 100 ms, and the number of pulses is 70.

We noted that protein electroporation and other methods of transfection are compatible in activating/inducing/reprogramming a cell. Accordingly, the invention covers the use of electroporation (with or without a transfectant) in combination with other methods taught herein as well as with methods taught by others skilled in the art for activating, inducing or reprogramming a cell to a desirable phenotype.

The invention may be practiced in vivo using a variety of existing methods and equipment known to the art. However, the present invention also teaches a novel device for in vivo electroporation comprising a catheter and electrode(s).

In one embodiment, the catheter and electrode(s) are combined, with or without a camera and/or light a light source, as an assembly that can be optionally mounted on a wire or flexible tube such as are used for cardiac catheterization and for endoscopy.

In some embodiments, the electrodes are sharp and capable of piercing tissue.

In some embodiments, the electrodes are dull.

In some embodiments, said assembly may also comprise a needle enabling injection of a transfectant into a tissue and a reservoir (e.g. syringe) where the transfectant is stored immediately prior to injection.

In some embodiments, said assembly may comprise electrodes taking a form akin to "tweezertrodes".

In a preferred embodiment, cells are "selected" from accessible, dividing or non-dividing cell populations for the purpose of generating the desired a) proliferating, multipotent or pluripotent cell population, or b) differentiating populations of somatic cells; moreover the desired cell population may be capable of further differentiation in vitro, further differentiation in vivo, and/or tissue-appropriate and regionally-appropriate differentiation in vivo.

Sources of Cells Selected for Use in the Invention

Selected cells may include any cell practicable in the present invention. Cells selected for use in the present invention (herein termed "selected cells") may originate as endogenous cells of a subject or of a patient—including cells derived from other organ systems; or from exogenous sources (including those derived from cell lines, cryopreserved sources, banked sources, and donors). Cells may also be selected from cells genetically-modified with synthetic or natural nucleic acid sequences (or their corresponding proteins). The term "selected cells", as used herein, does not include human embryonic stem cells.

In embodiments of the present invention, in order that they may be isolated without the involvement of invasive procedures, selected cells will preferably be easily accessible cells (e.g. peripheral blood leukocytes, circulating hematopoietic stem cells, epithelial cells (e.g. buccal cheek cells (e.g. Michalczyk et al., 2004), excreted cells, adipose tissue cells (e.g. Gimble et al., 2007; Ma et al., 2007), umbilical cord blood cells (e.g. Zhao, et al., 2006; Tian et al., 2007), etc.). However, bone marrow derived cells, stem cells isolated from amniotic membranes (e.g. Ilancheran et al., 2007), or amniotic fluid (e.g. De Coppi et al., 2007), as well as cells isolated from the skin (e.g. Tumbar, 2006; Dunnwald et al., 2001; Szudal'tseva et al., 2007), etc., are also covered by the present invention. Such cells can be isolated from the tissues in which they reside by any means known to the art.

The selected cells may be genetically-modified cells, especially cells that have been genetically modified by any means known to the art, to encode therapeutic or commercially useful deoxyribonucleic acid (DNA) or ribonucleic acid (RNA) sequences.

The selected cells may be genetically-modified cells, especially cells that have been genetically modified by any means known to the art, to encode therapeutic or commercially useful deoxyribonucleic acid (DNA) or ribonucleic acid (RNA) sequences, including through the use of CRISPR/CAS9 or other methods included in the category of site-specific genetic modification.

In accordance with an aspect of the present invention, there is provided a method of producing a desired, developmentally activated cell population (e.g. pluripotent, pluripotent-like, neuronal, muscle, etc.) from the selected cells.

Achieving multipotent, pluripotent, self renewing, "VSEL-like" and/or "pluripotent-like", developmentally activated cell populations:

In a preferred embodiment, a population of proliferating, self renewing, pluripotent or pluripotent-like cells is derived from the selected cell(s) and/or their progeny when said selected cells are transfected with nucleotide sequence(s) or proteins including those encoding the "long" (PRR insert +) isoform(s) of the mammalian numb gene (or other cell fate determinants taught herein for producing proliferating, self renewing, pluripotent or pluripotent-like cells, see below). At about the same time the selected cells may optionally be transfected with synthetic oligonucleotides targeting the short Numb isoforms and Numblike. When performed in vitro, the cells are subsequently cultured under conditions which promote growth of the selected cells at an optimal growth rate. Selected cells are maintained under these conditions for the period of time sufficient to achieve the desired cell number. When transfection is performed in vivo, no further steps are required.

Transfected cells maintained in vitro may be grown under a variety of growth conditions known to the art, and optionally at the (optimal) rate of growth achieved by incubation with LIF, steel factor, and/or equipotent concentrations of Il-6, hyper IL-6, IL-7, oncostatin-M and/or cardiotrophin-1; or optionally that growth rate achieved in the presence of other growth enhancing cytokines (e.g. those conditions described for culturing pluripotent cells e.g. Guan et al., 2006), and/or chemicals selected from VC6TFZ: VPA, 5-aza-cytidine, CHIR99021 (CHIR), 616452, Tranylcypromine, Forskolin (FSK), 2-methyl-5-hydroxytryptamine (2-Me-5HT), and D4476. The growth rate is determined from the doubling times of the selected cells in said growth culture medium. Likewise, culture conditions such as those described in U.S. Pat. Nos. 6,432,711 and 5,453,357 may also be suitable for the propagation and expansion, at an optimal growth rate, of cells transfected with the long (PRR+) Numb isoform(s). Other appropriate protocols and reference cytokine concentrations have been taught by Koshimizu et al., 1996; Keller et al., 1996; Piquet-Pellorce, 1994; Rose et al., 1994; Park and Han, 2000; Guan et al., 2006; Dykstra et al., 2006; Zhang et al., 2007). However, the practice of the present invention is not limited to the details of these teachings. The cell culture medium need not necessarily contain a cytokine and need not necessarily contain serum and many serum free cell culture media are known to the art.

In a preferred embodiment, the selected cells are cultured in a standard growth medium (e.g. Minimal Essential Medium with or without supplements (e.g. glutamine, and beta.-mercaptoethanol). The medium may include basic fibroblast growth factor (bFGF), steel factor, leukemia inhibitory factor (LIF), and/or factors with LIF activity (e.g. LIF, LIF receptor (LIFR), ciliary Neurotrophic factor (CNTF), oncostatin M (OSM), OSM receptor (OSMR), cardiotrophin, interleukins (IL) such as IL-6, hyper IL-6, GP130, etc.) as well as horse serum. LIF, as well as other factors with LIF activity, prevents spontaneous differentiation of the cells. Under these conditions, selected cells transfected with the cell fate determinants taught herein and their progeny are expected to achieve multipotency, pluripotency and/or self-renewal.

In a preferred embodiment, the selected cell(s) and/or their progeny are transfected with, or overexpress, nucleotide sequence(s) encoding cell fate determinants (or their corresponding proteins), as well as sequences encoding other transgenes (or their corresponding proteins). Many of those transgenes are listed below along with their corresponding identification numbers (accession numbers) in the NCBI sequence database.

In another preferred embodiment, the selected cell(s) and/or their progeny are transfected with, or overexpress, nucleotide sequence(s) encoding a portion of the "long" (PRR insert +) Numb isoform(s) (or their corresponding proteins), as well as sequences encoding other transgenes (or their corresponding proteins). Many of those transgenes are listed below along with their corresponding identification (accession) numbers (codes) in the NCBI sequence database.

In a preferred embodiment, the selected cells and/or their progeny are transfected with, or overexpress, long (PRR+) Numb isoform encoding sequences (or their corresponding proteins), as well as sequences encoding other transgenes (or their corresponding proteins), including LIF.

In a preferred embodiment, the selected cells and/or their progeny are transfected with, or overexpress, long (PRR+) Numb isoform encoding sequences (or their corresponding proteins) as well as sequences encoding other transgenes (or their corresponding proteins), including ones with LIF activity.

In a preferred embodiment, the selected cells and/or their progeny are transfected with, or overexpress, long (PRR+) Numb isoform(s) encoding sequences (or their corresponding proteins), as well as sequences encoding other transgenes (or their corresponding proteins), including the LIFR.

In a preferred embodiment, the selected cells and/or their progeny are transfected with, or overexpress, long (PRR+) Numb isoform(s) encoding sequences (or their corresponding proteins) as well as sequences encoding other transgenes (or their corresponding proteins), including oncostatin M (OSM).

In a preferred embodiment, the selected cells and/or their progeny are transfected with, or overexpress, long (PRR+) Numb isoform(s) encoding sequences (or their corresponding proteins) as well as sequences encoding other transgenes (or their corresponding proteins), including oncostatin M receptor (OSMR).

In a preferred embodiment, the selected cells and/or their progeny are transfected with, or overexpress, long (PRR+) Numb isoform(s) encoding sequences (or their corresponding proteins) as well as sequences encoding other transgenes (or their corresponding proteins), including cardiotrophin-1.

In a preferred embodiment, the selected cells and/or their progeny are transfected with, or overexpress, long (PRR+) Numb isoform(s) encoding sequences (or their corresponding proteins) as well as sequences encoding other transgenes (or their corresponding proteins), including CNTF.

In a preferred embodiment, the selected cells and/or their progeny are transfected with, or overexpress, long (PRR+)

Numb isoform(s) encoding sequences (or their corresponding proteins) as well as sequences encoding other transgenes (or their corresponding proteins), including one or more selected from Oct3/4 and/or SOX2.

In a preferred embodiment, the selected cells and/or their progeny are transfected with, or overexpress, long (PRR+) Numb isoform(s) encoding sequences (or their corresponding proteins) as well as sequences encoding other transgenes (or their corresponding proteins), including NANOG, OCT3/4 and/or SOX2.

In a preferred embodiment, the selected cells and/or their progeny are transfected with, or overexpress, long (PRR+) Numb isoform(s) encoding sequences (or their corresponding proteins) as well as sequences encoding other transgenes (or their corresponding proteins), including one or more selected from Oct3/4 and SOX2 and/or a transgene with LIF activity.

In a preferred embodiment, the selected cells and/or their progeny are transfected with, or overexpress, sequences encoding other transgenes (or their corresponding proteins), including one or more selected from Oct3/4 and/or SOX2 and a transgene with LIF activity.

In a preferred embodiment, the selected cells and/or their progeny are transfected with, or overexpress, long (PRR+) Numb isoform(s) encoding sequences (or their corresponding proteins) as well as sequences encoding other transgenes (or their corresponding proteins), including Notch (e.g. Gaiano et al., 2000).

In a preferred embodiment, the selected cells and/or their progeny are transfected with, or overexpress, long (PRR+) Numb isoform(s) encoding sequences (or their corresponding proteins) as well as sequences encoding other transgenes (or their corresponding proteins), including one or more selected from Oct3/4, SOX2 and/or Notch (e.g. notch 1 and/or notch 2).

In a preferred embodiment, the selected cells and/or their progeny are transfected with, or overexpress, long (PRR+) Numb isoform(s) encoding sequences (or their corresponding proteins) as well as sequences encoding other transgenes (or their corresponding proteins), including one or more selected from OCT3/4, SOX2, NANOG, and/or Notch.

In a preferred embodiment, the selected cells and/or their progeny are transfected with, or overexpress, long (PRR+) Numb isoform(s) encoding sequences (or their corresponding proteins) as well as sequences encoding other transgenes (or their corresponding proteins), including one or more selected from OCT3/4, SOX2, NANOG, and/or a transgene with LIF activity.

In a preferred embodiment, the selected cells and/or their progeny are transfected with, or overexpress, long (PRR+) Numb isoform(s) encoding sequences (or their corresponding proteins) as well as sequences encoding other transgenes (or their corresponding proteins), including one or more selected from OCT3/4, SOX2, NANOG, and/or multiple transgenes (or their corresponding proteins) with LIF activity.

In a preferred embodiment, the selected cells and/or their progeny are transfected with, or overexpress, long (PRR+) Numb isoform(s) encoding sequences (or their corresponding proteins) as well as sequences encoding other transgenes (or their corresponding proteins), including one or more selected from OCT3/4, Notch, HOXB4 and/or SOX2.

Over time, other gene combinations differing from those described herein may be described or discovered capable of causing cells to become multipotent, pluripotent, capable of self-renewal, or to begin differentiating. However this patent application covers such "genetic reprogramming" of any nucleated cell utilizing nucleic acid or protein electroporation (see Gagne et al., 1991; Saito et al., 2001; Yuan, 2008; Huang et al., 2007; Xia and Zhang, 2007; Cemazar and Sersa 2007; Isaka and Imai, 2007; Luxembourg et al., 2007; Van Tendeloos, 2007; Takahashi, 2007; etc.), liposomes, nanocapsules, nanovaults, etc. (see Goldberg et al., 2007; Li et al., 2007), and/or another approach avoiding viral integration or other random alteration of the cell's genome, as such means increase safety and efficiency.

Excluded, of course, from the category of "random alteration" are approaches involving gene-targeting and site-directed methods (e.g. CRISPR/CAS9) designed to introduce or remove DNA at specific locations in the genome; and the use of CRISPR/CAS9 to practice the invention is covered by the present invention.

Likewise, this patent application covers the genetic reprogramming of any nucleated cell utilizing nucleic acid or protein electroporation, liposomes, nanocapsules, nanovaults, etc., and/or another approach avoiding retroviral/lentiviral integration or other random alteration of the cell's genome, as such means increase safety and efficiency. Such approaches and methods include all known to the art and practicable in the present invention.

In a preferred embodiment, in order to produce developmental activation, nucleic acid(s) or protein(s) corresponding to a single gene, or portion thereof, (particularly those named herein, discovered according to methods described herein, discovered according to other published methods; or known to be multipotency, pluripotency, or self-renewal inducing) are the only nucleic acid(s) or protein(s) overexpressed and/or introduced to produce dividing, self-renewing, muiltipotent, pluripotent, "VSEL-like" and/or "pluripotent-like" cells from the selected cells.

In a preferred embodiment, in order to produce developmental activation, nucleic acid(s) or protein(s) corresponding to a single gene, or portion thereof, (particularly those named herein, discovered according to methods described herein, discovered according to other published methods; or known to be mutiltipotency, pluripotency, or self-renewal inducing) are the only nucleic acid(s) or protein(s) overexpressed and/or introduced to produce dividing, self-renewing, multipotent, pluripotent, "VSEL-like" and/or "pluripotent-like" cells from the selected cells and the method utilized is electroporation, liposomes, nanocapsules, nanovaults, and/or another approach avoiding retroviral/lentiviral integration or other random alteration of the cell's genome.

In a separate preferred embodiment, in order to produce developmental activation, other nucleic acid(s), protein(s) or other transfectants can be utilized in concert with the nucleic acid(s) or protein(s) corresponding to a single gene, or portion thereof, (particularly those named herein, discovered according to methods described herein, discovered according to other published methods; or known to be multipotency, pluripotency, or self-renewal inducing) so long as a population of dividing, self-renewing, multipotent, pluripotent, "VSEL-like" and/or "pluripotent-like" cells is produced from the selected cells.

In a separate preferred embodiment, in order to produce developmental activation, other nucleic acid(s), protein(s) or other transfectants can be utilized in concert with the nucleic acid(s) or protein(s) corresponding to a single gene, or portion thereof, (particularly those named herein, discovered according to methods described herein, discovered according to other published methods; or known to be multipotency, pluripotency, or self-renewal inducing) so long as a population of dividing, self-renewing, multipotent, pluripotent, "VSEL-like" and/or "pluripotent-like" cells is produced from the selected cells and the method utilized is electroporation, liposomes, nanocapsules, nanovaults, and/or another approach avoiding retroviral/lentiviral integration or other random alteration of the cell's genome.

In a preferred embodiment, in order to produce developmental activation, nucleic acid(s) or protein(s) corresponding to Nanog are the only nucleic acid(s) or protein(s) overexpressed and/or introduced to produce dividing, self-renewing, multipotent, pluripotent, "VSEL-like" and/or "pluripotent-like" cells from the selected cells and the method utilized is electroporation, liposomes, nanocapsules, nanovaults, and/or another approach avoiding retroviral/lentiviral integration or other random alteration of the cell's genome.

In a separate preferred embodiment, in order to produce developmental activation, other nucleic acid(s), protein(s) or other transfectants can be utilized in concert with the nucleic acid(s) or protein(s) corresponding to Nanog so long as a population of dividing, self-renewing, multipotent, pluripotent, "VSEL-like" and/or "pluripotent-like" cells is produced from the selected cells and the method utilized is electroporation, liposomes, nanocapsules, nanovaults, and/or another approach avoiding viral integration or other random alteration of the cell's genome.

In a separate preferred embodiment, nucleic acid(s) or protein(s) corresponding to Oct4 and Sox2 are the only nucleic acid(s) or protein(s) overexpressed and/or introduced to produce dividing, self-renewing, multipotent, pluripotent, "VSEL-like" and/or "pluripotent-like" cells from the selected cells and the method utilized is electroporation, liposomes, nanocapsules, nanovaults, and/or another approach avoiding viral integration or other random alteration of the cell's genome.

In a separate preferred embodiment, in order to produce developmental activation, other nucleic acid(s) or protein(s) are utilized in concert with the nucleic acid(s) or protein(s) corresponding to Oct4/Sox2 so long as a population of dividing, self-renewing, multipotent, pluripotent, "VSEL-like" and/or "pluripotent-like" cells is produced from the selected cells and the method utilized is electroporation, liposomes, nanocapsules, nanovaults, and/or another approach avoiding viral integration or other random alteration of the cell's genome.

In a separate preferred embodiment, nucleic acid(s) or protein(s) corresponding to Nxx3-1 are utlized to produce a population of dividing, self-renewing, multipotent, pluripotent, "VSEL-like" and/or "pluripotent-like" cells from the selected cells.

In a separate preferred embodiment, nucleic acid(s) or protein(s) corresponding to Long (PRR+) Numb isoforms are the only nucleic acid(s) or protein(s) overexpressed and/or introduced to produce dividing, self-renewing, multipotent, pluripotent, "VSEL-like" and/or "pluripotent-like" cells from the selected cells and the method utilized is electroporation, liposomes, nanocapsules, nanovaults, and/or another approach avoiding viral integration or other random alteration of the cell's genome.

In a separate preferred embodiment, in order to produce developmental activation, other nucleic acid(s) or protein(s) are utilized in concert with the nucleic acid(s) or protein(s) corresponding to Long (PRR+) Numb isoforms so long as a population of dividing, self-renewing, multipotent, pluripotent, "VSEL-like" and/or "pluripotent-like" cells is produced from the selected cells and the method is electroporation, liposomes, nanocapsules, nanovaults, and/or another approach avoiding viral integration or other random alteration of the cell's genome.

In a preferred embodiment, in order to produce developmental activation, nucleic acid(s) or protein(s) corresponding to Nanog are the only nucleic acid(s) or protein(s) overexpressed and/or introduced to produce dividing, self-renewing, multipotent, pluripotent, "VSEL-like" and/or "pluripotent-like" cells from the selected cells.

In a preferred embodiment, in order to produce developmental activation, nucleic acid(s) or protein(s) corresponding to Nanog are the only nucleic acid(s) or protein(s) overexpressed and/or introduced to produce dividing, self-renewing, multipotent, pluripotent, "VSEL-like" and/or "pluripotent-like" cells from the selected cells and the method utilized is electroporation, liposomes, nanocapsules, nanovaults, and/or another approach avoiding retroviral/lentiviral integration or other random alteration of the cell's genome.

In a separate preferred embodiment, in order to produce developmental activation, other nucleic acid(s), protein(s) or other transfectants can be utilized in concert with the nucleic acid(s) or protein(s) corresponding to Nanog so long as a population of dividing, self-renewing, multipotent, pluripotent, "VSEL-like" and/or "pluripotent-like" cells is produced from the selected cells.

In a separate preferred embodiment, in order to produce developmental activation, other nucleic acid(s), protein(s) or other transfectants can be utilized in concert with the nucleic acid(s) or protein(s) corresponding to Nanog so long as a population of dividing, self-renewing, multipotent, pluripotent, "VSEL-like" and/or "pluripotent-like" cells is produced from the selected cells and the method utilized is electroporation, liposomes, nanocapsules, nanovaults, and/or another approach avoiding retroviral/lentiviral integration or other random alteration of the cell's genome.

In a preferred embodiment, in order to produce developmental activation, nucleic acid(s) or protein(s) corresponding to a gene with LIF activity are the only nucleic acid(s) or protein(s) overexpressed and/or introduced to produce dividing, self-renewing, multipotent, pluripotent, "VSEL-like" and/or "pluripotent-like" cells from the selected cells.

In a preferred embodiment, in order to produce developmental activation, nucleic acid(s) or protein(s) corresponding to a gene with LIF activity are the only nucleic acid(s) or protein(s) overexpressed and/or introduced to produce dividing, self-renewing, multipotent, pluripotent, "VSEL-like" and/or "pluripotent-like" cells from the selected cells and the method utilized is electroporation, liposomes, nanocapsules, nanovaults, and/or another approach avoiding retroviral/lentiviral integration or other random alteration of the cell's genome.

In a separate preferred embodiment, in order to produce developmental activation, other nucleic acid(s), protein(s) or other transfectants can be utilized in concert with the nucleic acid(s) or protein(s) corresponding to to a gene with LIF activity so long as a population of dividing, self-renewing, multipotent, pluripotent, "VSEL-like" and/or "pluripotent-like" cells is produced from the selected cells.

In a separate preferred embodiment, in order to produce developmental activation, other nucleic acid(s), protein(s) or other transfectants can be utilized in concert with the nucleic acid(s) or protein(s) corresponding to a gene with LIF activity so long as a population of dividing, self-renewing, multipotent, pluripotent, "VSEL-like" and/or "pluripotent-like" cells is produced from the selected cells and the method utilized is electroporation, liposomes, nanocapsules, nanovaults, and/or another approach avoiding retroviral/lentiviral integration or other random alteration of the cell's genome.

In a preferred embodiment, in order to produce developmental activation, nucleic acid(s) or protein(s) corresponding to Oct4 are the only nucleic acid(s) or protein(s) overexpressed and/or introduced to produce dividing, self-renewing, multipotent, pluripotent, "VSEL-like" and/or "pluripotent-like" cells from the selected cells.

In a preferred embodiment, in order to produce developmental activation, nucleic acid(s) or protein(s) corresponding to Oct4 are the only nucleic acid(s) or protein(s) overexpressed and/or introduced to produce dividing, self-renewing, multipotent, pluripotent, "VSEL-like" and/or "pluripotent-like" cells from the selected cells and the method utilized is electroporation, liposomes, nanocapsules, nanovaults, and/or another approach avoiding retroviral/lentiviral integration or other random alteration of the cell's genome.

In a separate preferred embodiment, in order to produce developmental activation, other nucleic acid(s), protein(s) or other transfectants can be utilized in concert with the nucleic acid(s) or protein(s) corresponding to Oct4 so long as a population of dividing, self-renewing, multipotent, pluripotent, "VSEL-like" and/or "pluripotent-like" cells is produced from the selected cells.

In a separate preferred embodiment, in order to produce developmental activation, other nucleic acid(s), protein(s) or other transfectants can be utilized in concert with the nucleic acid(s) or protein(s) corresponding to Oct4 so long as a population of dividing, self-renewing, multipotent, pluripotent, "VSEL-like" and/or "pluripotent-like" cells is produced from the selected cells and the method utilized is electroporation, liposomes, nanocapsules, nanovaults, and/or another approach avoiding retroviral/lentiviral integration or other random alteration of the cell's genome.

In a preferred embodiment, in order to produce developmental activation, nucleic acid(s) or protein(s) corresponding to Sox2 are the only nucleic acid(s) or protein(s) overexpressed and/or introduced to produce dividing, self-renewing, multipotent, pluripotent, "VSEL-like" and/or "pluripotent-like" cells from the selected cells.

In a preferred embodiment, in order to produce developmental activation, nucleic acid(s) or protein(s) corresponding to Sox2 are the only nucleic acid(s) or protein(s) overexpressed and/or introduced to produce dividing, self-renewing, multipotent, pluripotent, "VSEL-like" and/or "pluripotent-like" cells from the selected cells and the method utilized is electroporation, liposomes, nanocapsules, nanovaults, and/or another approach avoiding retroviral/lentiviral integration or other random alteration of the cell's genome.

In a separate preferred embodiment, in order to produce developmental activation, other nucleic acid(s), protein(s) or other transfectants can be utilized in concert with the nucleic acid(s) or protein(s) corresponding to Sox2 so long as a population of dividing, self-renewing, multipotent, pluripotent, "VSEL-like" and/or "pluripotent-like" cells is produced from the selected cells.

In a separate preferred embodiment, in order to produce developmental activation, other nucleic acid(s), protein(s) or other transfectants can be utilized in concert with the nucleic acid(s) or protein(s) corresponding to Sox2 so long as a population of dividing, self-renewing, multipotent, pluripotent, "VSEL-like" and/or "pluripotent-like" cells is produced from the selected cells and the method utilized is electroporation, liposomes, nanocapsules, nanovaults, and/or another approach avoiding retroviral/lentiviral integration or other random alteration of the cell's genome.

In a preferred embodiment, in order to produce developmental activation, nucleic acid(s) or protein(s) corresponding to lin28 are the only nucleic acid(s) or protein(s) overexpressed and/or introduced to produce dividing, self-renewing, multipotent, pluripotent, "VSEL-like" and/or "pluripotent-like" cells from the selected cells.

In a preferred embodiment, in order to produce developmental activation, nucleic acid(s) or protein(s) corresponding to lin28 are the only nucleic acid(s) or protein(s) overexpressed and/or introduced to produce dividing, self-renewing, multipotent, pluripotent, "VSEL-like" and/or "pluripotent-like" cells from the selected cells and the method utilized is electroporation, liposomes, nanocapsules, nanovaults, and/or another approach avoiding retroviral/lentiviral integration or other random alteration of the cell's genome.

In a separate preferred embodiment, in order to produce developmental activation, other nucleic acid(s), protein(s) or other transfectants can be utilized in concert with the nucleic acid(s) or protein(s) corresponding to lin28 so long as a population of dividing, self-renewing, multipotent, pluripotent, "VSEL-like" and/or "pluripotent-like" cells is produced from the selected cells and the method utilized is electroporation, liposomes, nanocapsules, nanovaults, and/or another approach avoiding retroviral/lentiviral integration or other random alteration of the cell's genome.

In a preferred embodiment, in order to produce developmental activation, nucleic acid(s) or protein(s) corresponding to c-myc are the only nucleic acid(s) or protein(s) overexpressed and/or introduced to produce dividing, self-renewing, multipotent, pluripotent, "VSEL-like" and/or "pluripotent-like" cells from the selected cells.

In a preferred embodiment, in order to produce developmental activation, nucleic acid(s) or protein(s) corresponding to c-myc are the only nucleic acid(s) or protein(s) overexpressed and/or introduced to produce dividing, self-renewing, multipotent, pluripotent, "VSEL-like" and/or "pluripotent-like" cells from the selected cells and the method utilized is electroporation, liposomes, nanocapsules, nanovaults, and/or another approach avoiding retroviral/lentiviral integration or other random alteration of the cell's genome.

In a separate preferred embodiment, in order to produce developmental activation, other nucleic acid(s), protein(s) or other transfectants can be utilized in concert with the nucleic acid(s) or protein(s) corresponding to c-myc so long as a population of dividing, self-renewing, multipotent, pluripotent, "VSEL-like" and/or "pluripotent-like" cells is produced from the selected cells.

In a separate preferred embodiment, in order to produce developmental activation, other nucleic acid(s), protein(s) or other transfectants can be utilized in concert with the nucleic acid(s) or protein(s) corresponding to c-myc so long as a population of dividing, self-renewing, multipotent, pluripotent, "VSEL-like" and/or "pluripotent-like" cells is produced from the selected cells and the method utilized is electroporation, liposomes, nanocapsules, nanovaults, and/or another approach avoiding retroviral/lentiviral integration or other random alteration of the cell's genome.

In a separate preferred embodiment, nucleic acid(s) or protein(s) corresponding Oct4 and/or Sox2 are the only nucleic acid(s) or protein(s) overexpressed and/or introduced to produce dividing, self-renewing, multipotent, pluripotent, "VSEL-like" and/or "pluripotent-like" cells from the selected cells.

In a separate preferred embodiment, nucleic acid(s) or protein(s) corresponding to Oct4 and/or Sox2 are the only nucleic acid(s) or protein(s) overexpressed and/or introduced to produce dividing, self-renewing, multipotent, pluripotent, "VSEL-like" and/or "pluripotent-like" cells from the selected cells and the method utilized is electroporation, liposomes, nanocapsules, nanovaults, and/or another approach avoiding retroviral/lentiviral integration or other random alteration of the cell's genome.

In a separate preferred embodiment, in order to produce developmental activation, other nucleic acid(s) or protein(s) are utilized in concert with the nucleic acid(s) or protein(s) corresponding to Oct4 and/or Sox2 so long as a population of dividing, self-renewing, multipotent, pluripotent, "VSEL-like" and/or "pluripotent-like" cells is produced from the selected cells.

In a separate preferred embodiment, in order to produce developmental activation, other nucleic acid(s) or protein(s) are utilized in concert with the nucleic acid(s) or protein(s) corresponding to Oct4 and/or Sox2 so long as a population of dividing, self-renewing, multipotent, pluripotent, "VSEL-like" and/or "pluripotent-like" cells is produced from the selected cells and the method utilized is electroporation, liposomes, nanocapsules, nanovaults, and/or another approach avoiding retroviral/lentiviral integration or other random alteration of the cell's genome.

In a separate preferred embodiment, nucleic acid(s) or protein(s) corresponding to Long (PRR+) Numb isoforms are the only nucleic acid(s) or protein(s) overexpressed and/or introduced to produce dividing, self-renewing, multipotent, pluripotent, "VSEL-like" and/or "pluripotent-like" cells from the selected cells.

In a separate preferred embodiment, nucleic acid(s) or protein(s) corresponding to Long (PRR+) Numb isoforms are the only nucleic acid(s) or protein(s) overexpressed and/or introduced to produce dividing, self-renewing, multipotent, pluripotent, "VSEL-like" and/or "pluripotent-like" cells from the selected cells and the method utilized is electroporation, liposomes, nanocapsules, nanovaults, and/or another approach avoiding retroviral/lentiviral integration or other random alteration of the cell's genome.

In a separate preferred embodiment, in order to produce developmental activation, other nucleic acid(s) or protein(s) are utilized in concert with the nucleic acid(s) or protein(s) corresponding to Long (PRR+) Numb Isoforms so long as a population of dividing, self-renewing, multipotent, pluripotent, "VSEL-like" and/or "pluripotent-like" cells is produced from the selected cells.

In a separate preferred embodiment, in order to produce developmental activation, other nucleic acid(s) or protein(s) are utilized in concert with the nucleic acid(s) or protein(s) corresponding to Long (PRR+) Numb Isoforms so long as a population of dividing, self-renewing, multipotent, pluripotent, "VSEL-like" and/or "pluripotent-like" cells is produced from the selected cells and the method utilized is electroporation, liposomes, nanocapsules, nanovaults, and/or another approach avoiding retroviral/lentiviral integration or other random alteration of the cell's genome.

In a separate preferred embodiment, nucleic acid(s) or protein(s) corresponding to Oct4, Sox2, and/or Nanog are the only nucleic acid(s) or protein(s) overexpressed and/or introduced to produce dividing, self-renewing, multipotent, pluripotent, "VSEL-like" and/or "pluripotent-like" cells from the selected cells.

In a separate preferred embodiment, nucleic acid(s) or protein(s) corresponding to Oct4, Sox2, and/or Nanog are the only nucleic acid(s) or protein(s) overexpressed and/or introduced to produce dividing, self-renewing, multipotent, pluripotent, "VSEL-like" and/or "pluripotent-like" cells from the selected cells and the method utilized is electroporation, liposomes, nanocapsules, nanovaults, and/or another approach avoiding retroviral/lentiviral integration or other random alteration of the cell's genome.

In a separate preferred embodiment, in order to produce developmental activation, other nucleic acid(s) or protein(s) are utilized in concert with the nucleic acid(s) or protein(s) corresponding to Oct4, Sox2, and/or Nanog so long as a population of dividing, self-renewing, multipotent, pluripotent, "VSEL-like" and/or "pluripotent-like" cells is produced from the selected cells.

In a separate preferred embodiment, in order to produce developmental activation, other nucleic acid(s) or protein(s) are utilized in concert with the nucleic acid(s) or protein(s) corresponding to Oct4, Sox2, and/or Nanog so long as a population of dividing, self-renewing, multipotent, pluripotent, "VSEL-like" and/or "pluripotent-like" cells is produced from the selected cells and the method utilized is electroporation, liposomes, nanocapsules, nanovaults, and/or another approach avoiding retroviral/lentiviral integration or other random alteration of the cell's genome.

In a separate preferred embodiment, nucleic acid(s) or protein(s) corresponding to Long (PRR+) Numb isoforms are the only nucleic acid(s) or protein(s) overexpressed and/or introduced to produce dividing, self-renewing, multipotent, pluripotent, "VSEL-like" and/or "pluripotent-like" cells from the selected cells.

In a separate preferred embodiment, nucleic acid(s) or protein(s) corresponding to Long (PRR+) Numb isoforms are the only nucleic acid(s) or protein(s) overexpressed and/or introduced to produce dividing, self-renewing, multipotent, pluripotent, "VSEL-like" and/or "pluripotent-like" cells from the selected cells and the method is electroporation, liposomes, nanocapsules, nanovaults, and/or another approach avoiding retroviral/lentiviral integration or other random alteration of the cell's genome.

In a separate preferred embodiment, in order to produce developmental activation, other nucleic acid(s) or protein(s) are utilized in concert with the nucleic acid(s) or protein(s) corresponding to Long (PRR+) Numb isoforms so long as a population of dividing, self-renewing, multipotent, pluripotent, "VSEL-like" and/or "pluripotent-like" cells is produced from the selected cells.

In a separate preferred embodiment, in order to produce developmental activation, other nucleic acid(s) or protein(s) are utilized in concert with the nucleic acid(s) or protein(s) corresponding to Long (PRR+) Numb isoforms so long as a population of dividing, self-renewing, multipotent, pluripotent, "VSEL-like" and/or "pluripotent-like" cells is produced from the selected cells and the method is electroporation, liposomes, nanocapsules, nanovaults, and/or another approach avoiding retroviral/lentiviral integration or other random alteration of the cell's genome.

It is to be understood that any combination of nucleic acid or protein sequences (or their corresponding proteins) described herein can be modified by excluding those corresponding to Numb and/or Numblike so long as the desired cell population or behavior is achieved.

Similarly, it should be understood that the methods described herein for initiating differentiation are applicable to any induced or non-induced multipotent, pluripotent, or self-renewing stem cells, other progenitor cells, or other somatic cells, not only those obtained in the manner described herein.

It is to be understood that any combination of nucleic acid or protein sequences (or their corresponding proteins) described herein can be modified by excluding nucleic acid sequences or proteins corresponding to Numb and/or Numblike so long as the desired cell population is achieved.

In another embodiment, the various nucleic acid or protein combinations described herein are employed with the exclusion of the nucleic acid or protein corresponding to the Numblike and/or Numb isoforms.

In a preferred embodiment, the selected cells and/or their progeny are cells that have been genetically-modified beforehand.

In a preferred embodiment, the transfection steps described herein represent transient transfection.

In a further preferred embodiment such transient transfection is accomplished using viral vectors that do not integrate into the host genome. Non-integrating and episomal viral vectors are well known to the art and include $2^{nd}$ and $3^{rd}$ generation, integrase-deficient, non-integrating lentiviral vectors, including $3^{rd}$ generation lentivectors taught herein. Such integrase-deficient vectors can be readily introduced using a variety of standard transfection techniques (e.g. electroporation, chemically mediated transfection, fusogenic or non-fusogenic liposomes, lipofectamine, nanocapsules, nanovaults, etc.)—methods which allow high capacity integrase-deficient lentiviral vectors to be utilized without genomic integration and random alteration of the genome (see FIG. 3D).

Over time, other gene combinations differing from those described herein may be described or discovered capable of causing cells to become multipotent, pluripotent, capable of self-renewal or to begin differentiating. However this patent application also covers the genetic reprogramming of any nucleated cell utilizing nucleic acid or protein electroporation (for example methods see Gagne et al., 1991; Saito et al., 2001; Yuan, 2008; Huang et al., 2007; Xia and Zhang, 2007; Cemazar and Sersa 2007; Isaka and Imai, 2007; Luxembourg et al., 2007; Van Tendeloos, 2007; Takahashi, 2007; etc.) electroporation, liposomes, nanocapsules, nanovaults, and/or another approach avoiding viral integration or other random alteration of the cell's genome as such means increase safety and efficiency.

In another preferred embodiment, transfection with (or overexpression of) long (PRR+) numb isoform encoding sequences (or their corresponding proteins) (and/or synthetic oligonucleotides targeting numblike and short numb isoforms) is accompanied or replaced by transient or permanent transfection with (or overexpression of) other sequences (or their corresponding proteins) including one or more selected from those encoding human LIF (e.g. Du and Shi, 1996) oncostatin-M, cardiotrophin-1, IL-11, IL-6, IL6R, hyper IL-6, LIFR, gp130, OCT3 (OCT4), Nanog, SOX2, and/or FGF-4.

Simultaneous transfection with (or overexpression of) any subset of these distinct transgene sequences (or their corresponding proteins) can be accomplished by any means known to the art including the use of a single genetic vector, multiple genetic vectors, serial transfection and selection based on distinct marker proteins and/or antibiotic resistances.

In another embodiment, the cells selected for developmental activation are cultured in a cell culture promoting an optimal growth rate, such as described above, and that includes EGF, bFGF, oncostatin, LIF (e.g. Du and Shi, 1996), steel factor, IL-11, cardiotrophin-1, IL-6, hyper-IL-6, CNTF, and/or soluble gp130.

In another embodiment, when neural progenitor cells are the desired cells, the cells selected for developmental activation are incubated in a growth medium comprising one or more of VPA, BIX01294, RG108, PD0325901, CHIR99021, vitamin C, CHIR99021, RepSox, A83-01, Thiazovivin, Purmophamin, LDN193189, and RG108, Assessment of Potency and Differentiation Pluripotency and multipotency can be assessed by any means known to the art including 1) transplantation, 2) culture under conditions promoting embryoid body formation, 3) injection of cells into animal blastocyst stage embryos with subsequent development, and 4) RNA expression assays (e.g. RT-PCR and microarray based analyses) for gene expression associated with differentiation, multipotency, pluripotency, etc. (see Guan et al., 2006), 5) colony-formation, as well as by ES-like morphology. One approach disclosed herein for detecting pluripotency in selected cells and/or their progeny involves transfection with (or overexpression of) a reporter construct comprising the Nanog promoter operably linked to a fluorescent protein gene. This allows identification and enrichment of Nanog expressing cells using Fluorescence Activated Cell Sorting (FACS), etc.

In a preferred embodiment, endogenous cells (e.g. cells surrounding a burn or injury site) are transfected in vivo with genetic vectors encoding the long (PRR+) numb isoform(s) alone or in conjunction with other transgenes (or their corresponding proteins) named herein to transiently promote renewed or increased cell proliferation. This approach can also be utilized clinically in the setting of hypoplastic tissues, disorders where stem/progenitor cells are abnormally depleted, and other disorders where the approach can be shown to be beneficial.

Achieving Differentiating Cell Populations

In order to achieve b) neural c) muscle d) and other cell populations capable of further environmentally-regulated differentiation in vivo, selected cell(s) and/or their progeny are optionally transfected with long (PRR+) Numb isoform sequence(s) and/or synthetic oligonucleotide sequences and expanded by growth for sufficient time to achieve the desirable number of cell progeny in vitro (as described above).

Following this optional step, the selected cells and/or their progeny are washed free of the cytokines and agents comprising the expansion/optimal growth media, and are optionally transfected with the nucleotide sequence(s) encoding the Numblike gene and/or "short" (PRR−) Numb isoform(s) and/or synthetic oligonucleotides targeting the long (PRR+) isoforms, etc. (e.g. Zaehres et al., 2005), then cultured under conditions which promote differentiation of the selected cells into the desired cell type(s).

In most instances, the cells are then cultured in the presence of 5-10% fetal bovine serum and agents(s) promoting differentiation of the selected cells and/or their progeny into a desired cell population. The presence of the fetal bovine and of the agents(s) provides for growth or proliferation at a rate that is less than the optimal (or expansion) growth rate, and favors differentiation of the cells into a desired cell population. The agents and precise culture conditions are selected according to the desired cell population as described below.

Achieving Neuronal or Neural Cell Populations

When the desired cell population is a neural cell population, the successfully transfected cells are cultured under conditions that promote growth at a rate which is less than the optimal rate and in the presence of agent(s) promoting differentiation of the cells into neural cells. Conditions promoting differentiation into neurons have been described in numerous publications including (Benninger et al., 2003; Chung et al. 2005; Harkany et al., 2004; Ikeda et al., 2004; Ikeda et al., 2005; Wernig et al., 2002; and Wernig et al., 2004). Furthermore, combining retinoic acid exposure with the presence of additional cytokines favors specific neuronal cell type differentiation in vitro (e.g. Soundararajan et al., 2006; Soundararajan et al., 2007; U.S. Pat. No. 6,432,711).

In a preferred embodiment, in vitro differentiation of neurons or neural cells occurs in the presence of 50 ng/mL nerve growth factor (NGF).

In a preferred embodiment, when a neuronal population is the desired cell population, transfection with (or overexpression of) sequences encoding short numb isoforms (and/or numblike) is accompanied or replaced by transient or permanent transfection with (or overexpression of) other sequences (or their corresponding proteins) including one or more selected from miR-124, miR-128, Nurr1, REN, Neurogenin1, Neurogenin2, Neurogenin3, Mash 1, Phox2b, Phox2a, dHand, Gata3, Shh, FGF8, Lmx1a, Lmx1b, Nkx2.2, Pet1, Lbx1, Ptx-3, Pitx2, Dix1, Dlx2, Dlx5, and/or Rnx.

In another preferred embodiment, when dopaminergic neurons are the desired neuronal population, transfection with (or overexpression of) sequences (or their corresponding proteins) encoding short numb isoforms (and/or numblike) is accompanied or replaced by transient or permanent transfection with (or overexpression of) other sequences (or their corresponding proteins) including one or more selected from those encoding Mash1 (Ascl1), Ngn2, Nurr1, Lmx1a, Lmx1b, Foxa2, Brn2, Mytl1, Otx2, and/or Ptx-3.

In another preferred embodiment, when serotonergic neurons are the desired neuronal population, transfection with (or overexpression of) sequences (or their corresponding proteins) encoding short numb isoforms (and/or numblike) is accompanied or replaced by transient or permanent transfection with (or overexpression of) other sequences (or their corresponding proteins) including one or more selected from those encoding Mash1 (Ascl1), Phox2b, Lmx1b, Nkx2.2, Gata2, Gata3 and/or Pet1.

In another preferred embodiment, when cholinergic neurons are the desired neuronal population, transfection with (or overexpression of) sequences (or their corresponding proteins) encoding short numb isoforms (and/or numblike) is accompanied or replaced by transient or permanent transfection with (or overexpression of) other sequences (or their corresponding proteins) including one or more selected from those encoding MASH1 (ASCL1), Phox2a and/or REST4.

In another preferred embodiment, when GABAergic neurons are the desired neuronal population, transfection with (or overexpression of) sequences (or their corresponding proteins) encoding short numb isoforms (and/or numblike) is accompanied or replaced by transient or permanent transfection with (or overexpression of) other sequences (or their corresponding proteins) including one or more selected from those encoding MASH1 (ASCL1), Phox2a and/or REST4, followed, optionally, by culture in media supplemented with LIF, Neurotrophin 3 (NT3), and/or nerve growth factor (NGF).

In another preferred embodiment, when noradrenergic neurons are the desired neuronal population, transfection with (or overexpression of) sequences (or their corresponding proteins) encoding short numb isoforms (and/or numblike) is accompanied or replaced by transient or permanent transfection with (or overexpression of) other sequences (or their corresponding proteins) including one or more selected from those encoding Mash1 (Ascl1), dHand, Phox2a, Phox2b, Brn2, Myt1, Gata2 and/or Gata3.

In another preferred embodiment, when GABAergic neurons are the desired neuronal population, transfection with (or overexpression of) sequences (or their corresponding proteins) encoding short numb isoforms (and/or numblike) is accompanied or replaced by transient or permanent transfection with (or overexpression of) other sequences (or their corresponding proteins) including one or more selected from those encoding Mash1 Ascl1), PITX2, Dlx2, Dlx5, antisense Hes1 RNA and/or other HES1 targeting synthetic oligonucleotides.

In another preferred embodiment, when a neuronal or neural cell population is the desired population, cells are cultured in a cell culture medium promoting differentiation, such as described above and that includes one or more of the following agents: retinoic acid, Forskolin, ISX9, CHIR99021, SB431542, I-BET151, Forskolin PD0325901, LDN193189, Pifithrin-α, SP600125, G06983, Y-27632, NT3, NGF, glial cell-line derived growth factor (GDNF), and interferon gamma (IFN-gamma).

Achieving Muscle Cell Populations

When the desired cell population is a muscle population, the successfully transfected cells are cultured in the presence of an agent promoting differentiation of the cells into muscle cells and growth at a rate less than the optimal rate. Conditions promoting differentiation into muscle cells have also been described previously (Nakamura et al., 2003; Pal and Khanna, 2005; Pipes et al., 2005; Albilez et al., 2006; Pal and Khanna, 2007; Behfar et al., 2007; U.S. Pat. No. 6,432,711). Furthermore, exposure of selected cells and/or their progeny to hexamethylene bis-acrylamide or dimethylsulfoxide in the presence of additional cytokines favors the initiation of muscle type differentiation in vitro.

In a preferred embodiment, when a cardiac muscle cell population is the desired population, cells transfected with short (PRR−) numb isoforms (and/or numblike) are cultured in a cell culture medium promoting differentiation into cardiomycytes (He et al., 2003; Guan et al., 2007; etc.), or that includes specific agents at concentrations promoting cardiac cell differentiation (e.g. 0.75%-1% dimethyl sulfoxide (DMSO), 20% normal bovine serum (NBS), 10(−7) mM retinoic acid (RA) and 20% cardiomyocytes conditioned medium (Hua et al., 2006).

In another preferred embodiment, when a cardiomyocyte muscle cell population is the desired population, transfection with (or overexpression of) sequences (or their corresponding proteins) encoding short numb isoforms (and/or numblike) is accompanied or replaced by transient or permanent transfection with (or overexpression of) other sequences (or their corresponding proteins) including one or more selected from miR-1-1, miR-1-2, miR-133, miR-208, miR-499 and those encoding Gata 4, Gata 5, Gata 6, myocardin, Esrrg, Mesp1, Zfpm2 Ets2, Mesp, Myocd, Nkx2.5, Hand2, Mef2c, JAK inhibitor I and Tbx5.

In a preferred embodiment, when a muscle cell population is the desired cell population, transfection with (or overexpression of) sequences (or their corresponding proteins) encoding short numb isoforms (and/or numblike) is accompanied or replaced by transient or permanent transfection with (or overexpression of) other sequences (or their corresponding proteins) including one or more selected from those encoding muscle type specific bHLH-encoding sequences (or their corresponding proteins), MyoD, Myogenin, Myf5, Myf6, Gata 4, Gata 5, Gata 6, Mef2, Tbx5, Hand2, Myocardin, Ifrd1 and/or other muscle transcription factors and small RNAs.

In a preferred embodiment, when a smooth muscle cell population is the desired cell population, transfection with (or overexpression of) sequences (or their corresponding proteins) encoding short numb isoforms (and/or numblike) is accompanied or replaced by transient or permanent transfection with (or overexpression of) other sequences (or their corresponding proteins) including one or more selected from those encoding the muscle type specific Myocardin nucleotide sequence.

In a preferred embodiment, when a skeletal muscle cell population is the desired cell population, transfection with (or overexpression of) sequences (or their corresponding proteins) encoding short numb isoforms (and/or numblike) is accompanied or replaced by transient or permanent transfection with (or overexpression of) other sequences (or their corresponding proteins) including one or more selected from those encoding the muscle type specific MyoD and myogenin nucleotide sequences.

Further, when the desired cell population is a skeletal muscle cell population, the transfected or overexpressed sequences may include one or more selected from miR-1, miR-1-1, miR-1-2, miR-206, miR-26a, miR-133, miR-133a-1 and miR-133a-2.

In a preferred embodiment, when an oligodendrocyte cell population is the desired cell population, transfection with (or overexpression of) sequences (or their corresponding proteins) encoding short numb isoforms (and/or numblike) is accompanied or replaced by transient or permanent transfection with (or overexpression of) other sequences (or their corresponding proteins) including one or more selected from those encoding the oligodendrocyte-specific OLIG1, OLIG2, Nkx2.2, Nkx6.2, Sox10, ST18, Gm98, Myt1, Zfp536 and Zfp488 nucleotide sequences.

Simultaneous transfection with (or overexpression of) any subset of these distinct transgene sequences (or their corresponding proteins) listed above can be accomplished by any means known to the art including the use of multiple genetic vectors, serial transfection as well as selection based on distinct marker proteins and/or antibiotic resistance.

When the desired cell population is a hematopoietic cell population, the differentiation medium may include specific agents at concentrations promoting differentiation into hematopoietic progenitor cells (e.g. vascular endothelial growth factor (VEGF), thrombopoietin, etc. (e.g. Ohmizono, 1997; Wang et al., 2005; Srivastava et al., 2007; Gupta et al., 2007) or differentiated hematopoietic cell types (according to methods known to the art for providing differentiated hematopoietic cell types from undifferentiated or pluripotent cells).

When the desired cell population is a germ cell population, the differentiation medium may include specific agents at concentrations promoting differentiation into germ cells (e.g. Nayernia et al. 2006a, 2006b).

When the desired cell population is a germ cell population, the differentiation medium includes specific agents at concentrations promoting differentiation into germ cells (e.g. Nayernia et al. 2006a, 2006b).

In a preferred embodiment, when a germ cell population is the desired cell population, transfection/contacting with short numb isoform (and/or numblike) proteins or with sequences encoding short numb isoform proteins (and/or numblike), is accompanied or replaced by transient or permanent transfection/contacting with other proteins and/or nucleic acid sequences, including ones selected from those encoding FIGLA, FIG alpha, DAZL, STRA8, FOXL2, OOGENESIN1, OOGENESIN2, OOGENESIN3, OOGENESIN4, SYCP2, SYCP3, SPO11, REC8, DMC1, MOS, STAG3, CCNB1, FOXO1, FOXO3, SOHLH1, SOHLH2, NOBOX, OBOX1, OBOX2, OBOX3, OBOX4, OBOX6, LHX8, LHX9, OOG1, SP1, ZFP38, TRF2, TB2/TRF3, TAF4B, TAF7L, TAF71, TIA1, PHTF1, TNP2, HILS1, DAZL, BMP15, PTTG3, AURKC, OTX2, SOX15, SOX30, FOXR1, ALF, OCT4, DPPA3/STELLA, ZFP38, RPS6KA3, HINFP, NPAT, SP1, SP3, HOXA1, HOXA7, HEX, YP30, ZP1, ZP2, ZP3, SFE1, SFE9, OPO, PLN, RDV, GLD1, MMU-MiR351, MMU-MiR615, MMU-MiR592, MMU-MiR882, MMU-MiR185, MMU-MiR491, MMU-MiR326, MMU-MiR330, MMU-MiR351.

For example, but not limiting, in one preferred embodiment, when a sperm or spermatocyte cell population is the desired cell population, transfection/contacting with short numb isoform (and/or numblike) proteins or with sequences encoding short numb isoform proteins (and/or numblike), is accompanied or replaced by transient or permanent transfection/contacting with other proteins and/or nucleic acid sequences, including ones selected from those encoding SYCP2, SYCP3, SPO11, REC8, DMC1, MOS, STAG3, OCT4, ALF, RPS6KA3, HINFP, SP1, SP3, TAF71, TIA1, PHTF1, TNP2, HILS1, CLGN, TEKT1, FSCN3, DNAHC8, LDHC, ADAM3, OAZ3, AKAP3, MMU-MiR351, MMU-MiR615, MMU-MiR592, MMU-MiR882, and MMU-MiR185.

For example, but not limiting, in one preferred embodiment, when a oocyte cell population is the desired cell population, transfection/contacting with short numb isoform (and/or numblike) proteins or with sequences encoding short numb isoform proteins (and/or numblike), is accompanied or replaced by transient or permanent transfection/contacting with other proteins and/or nucleic acid sequences, including ones selected from those encoding MOS, CCNB1, OCT4, FIG alpha, FIGL alpha, ALF, SOHLH1, SOHLH2, LHX8, LHX9, OOG1, FIG alpha, SP1, LHX3, LHX9, TBP2/TRF3, DAZL, BMP15, GDF9, PTTG3, AURKC, OTX2, SOX15, SOX30, FOXR1, NOBOX, OBOX1, OBOX2, OBOX3, OBOX6, OOGENESIN1, OOGENESIN2, OOGENESIN3, OOGENESIN4, YP30, ZP1, ZP2, ZP3, SFE1, SFE9, OPO, PLN RDV, GLD1, DAZL, STRA8, MMU-MiR615, MMU-MiR491, MMU-MiR326, MMU-MiR330, MiR212 and MMU-MiR351.

When the desired cell population is an endoderm and pancreatic islet cell population, the differentiation media may include specific agents at concentrations promoting differentiation into endoderm and pancreatic islet cells (e.g. Xu et al., 2006; Denner et al., 2007; Shim et al., 2007; Jiang et al., 2007).

In a preferred embodiment, differentiation of selected cells and/or their progeny may occur in the differentiation medium in the absence of transfection with (or overexpression of) numblike, short Numb isoforms (or their corresponding proteins), although the differentiation medium may be unchanged.

In embodiments, a single vector will be utilized which controls the expression of nucleotide sequence(s) encoding the "long" (PRR+) isoform(s) of the mammalian numb gene (and/or synthetic oligonucleotides targeting numblike or the short numb isoforms) under one regulable promoter (e.g. a tetracycline-regulated promoter), while the Numblike and short Numb isoforms (and/or synthetic oligonucleotides targeting the long (PRR+) isoforms) are expressed under the control of another, distinct, but also regulable promoter. Thus, the long (PRR+) numb isoform(s) can be expressed (and/or short isoforms repressed) when expansion of the selected cells is desired and an inducing agent (e.g. tetracycline) is added to the growth medium; later numblike and the short isoforms can be expressed (and/or long (PRR+) numb isoform(s) repressed) when differentiation is desired.

Alternatively, proteins and peptides corresponding to Numb isoforms, Notch, OCT3/4, SOX2, and/or other DNA sequences listed herein may be applied in analogous fashion to selected cells and/or their progeny via electroporation (e.g. Koken et al., 1994; Ritchie and Gilroy, 1998), using nanoparticles, cationic lipids, fusogenic liposomes (e.g. Yoshikawa et al., 2005; 2007), etc. in lieu of, or in combination with genetic transfection. Generally, electroporation allows for high transfection efficiency (and efficient production of the desired cells) without genomic integration of the transgene and is therefore associated with increased safety.

The DNA or RNA encoding protein(s) or polypeptide(s) promoting proliferation, multipotentiality, pluripotentiality or differentiation of the selected cells may be isolated in accordance with standard genetic engineering techniques (for example, by isolating such DNA from a cDNA library of the specific cell line) and placing it into an appropriate expression vector, which then is transfected into the selected cells.

In another preferred embodiment, endoderm and pancreatic islet cells are the desired population, and transfection with (or overexpression of) sequences (or their corresponding proteins) encoding short numb isoforms (and/or numblike) is accompanied or replaced by transient or permanent transfection with (or overexpression of) other sequences (or their corresponding proteins) including one or more selected from those encoding Foxa2, Sox17, HLXB9, Ngn3, Mafa, Mapk, Stat3 and/or Pdx1.

In another preferred embodiment, hepatocytes are the desired population, and transfection with (or overexpression of) sequences (or their corresponding proteins) encoding short numb isoforms (and/or numblike) is accompanied or replaced by transient or permanent transfection with (or overexpression of) other sequences (or their corresponding proteins) including one or more selected from those encoding hepatic nuclear factor (HNF)-1, HNF-3, HNF-4, HNF-6, Foxa3, Foxa1, Foxa2 or Gata4, Cebpa, Cebpb, Atf5, c-myc and Prox1.

In another preferred embodiment, hematopoietic cells are the desired population, and transfection with (or overexpression of) sequences (or their corresponding proteins) encoding short numb isoforms (and/or numblike) is accompanied or replaced by transient or permanent transfection with (or overexpression of) other sequences (or their corresponding proteins) including one or more selected from those encoding Runx1/aml1, Nov(Ccn3), Erg, Gata2, Lmo2, Runx1c, Scl, Runit1, Hlf, Prdm5, Pbx1, Zfp37, Mycn, Meis1, FOSB, GFI1, SPI1 and/or cell culture in the presence of colony stimulating factors specific for the desired cell populations. The Runx1/AML1a isoform is introduced when engraftment is desired and the b isoform when differentiation is desired (Creemers et al., 2006).

Further, when the desired hematopoietic cell is a progenitor cell population, the transfected or overexpressed sequences may include one or more selected from miR-128, miR-181, miR-16, miR-103 and miR-107.

Further, when the desired hematopoietic cell is a T lymphoid cell population, the transfected or overexpressed sequences may include miR-150.

Further, when the desired hematopoietic cell is a B lymphoid cell population, the transfected or overexpressed sequences may include one or more selected from miR-181, miR-155, miR-24, miR-17, miR-16, miR-103 and miR-107.

Further, when the desired hematopoietic cell is an erythroid cell population, the transfected or overexpressed sequences may include one or more selected from miR-150, miR-155, miR-221, miR-222, miR-451, miR-16 and miR-24.

Further, when the desired hematopoietic cell is a monocyte cell population, the transfected or overexpressed sequences may include one or more selected from miR-17-5p, miR-20a, miR-106a, miR-16, miR-103 and miR-107.

Further, when the desired hematopoietic cell is a granulocyte cell population, the transfected or overexpressed sequences may include one or more selected from miRNA-155, miR-24, miR-17, miR-223, miR-16, miR-103 and miR-107.

Further, when the desired hematopoietic cell is a megakaryocyte cell population, the transfected or overexpressed sequences may include one or more selected from miR-155, miR-24, and miR-17.

In another preferred embodiment, chondrocytes are the desired population, and transfection with (or overexpression of) sequences encoding short numb isoforms and/or numblike (or their corresponding proteins) is accompanied or replaced by transient or permanent transfection of other sequences (or their corresponding proteins) including one or more selected from ones encoding Sox9, CREB-binding protein, Gata6, Runx2, and TGF-beta.

In another preferred embodiment, bone cells (especially osteoblasts) are the desired population, and transfection with (or overexpression of) sequences encoding short numb isoforms and/or numblike (or their corresponding proteins) is accompanied or replaced by transient or permanent transfection of other sequences (or their corresponding proteins) including Runx2.

Further, when an osteoblast population is the desired cell population, transfection with (or overexpression of) sequences may include one or more small RNAs selected from miR-125b and miR-26a.

Further, when a keratinocyte population is the desired cell population, transfection with (or overexpression of) sequences may include one or more small RNAs selected from miR-203.

In a preferred embodiment, the genetic vectors encoding the long Numb isoforms (such as those described herein) are introduced transiently or under the control of a regulable promoter, into endogenous cells in vivo in order to cause those cells proliferate transiently.

In another embodiment, when i. brown adipocytes, ii. astrocytes, iii. endothelial cells, iv. macrophages/mocytes v. melanocytes, vi. neural stem cells, vii. glutamatergic neurons, viii. astrocytes, ix. motor neurons, or x. nephrogenic progenitors are desired cell population and transfection with (or overexpression of) sequences (or their corresponding proteins) encoding short numb isoforms (and/or numblike) is accompanied or replaced by transient or permanent transfection with (or overexpression of) other sequences (or their corresponding proteins) including one or more selected from i. PRDM16, and CEBPP, or ii. Nfia, Nfib, and Sox9, iii. Etv2, Fli1, Erg1, Foxo1, Er71, Klf2, Tal1, and Lmo2, iv. Sox2, miR-125b, PU.1, CEBP and CEBPO, v. Mitf, Sox10, Pax3, vi. Ascl1, Ngn2, Hes1, Id1, Pax6, Sox2, c-Myc, Brn2, Brn4, Klf4, c-Myc, and E47; vii. NeuroD1, Ascl1, Mytl1, Neurod2, miR-9/9, miR-124 viii. Ascl1, Ngn2 and Dlx2, ix. Brn2, Mash1, Mytl1, Lhx3, Hb9, Isl1, Ngn2, or Six1, Six2, Osr1, Eya1, Hoxa11, Snai2, respectively.

In a preferred embodiment, endogenous cells (e.g. ependymal zone cells of the central nervous system) are transfected in vivo with genetic vectors encoding either the shortest numb isoform or the numblike protein(s) alone or in conjunction with other transgenes (or their corresponding proteins) named herein, in order to transiently or permanently promote renewed or increased differentiation (especially neuronal differentiation) and migration of progenitor/ependymal cells in the central nervous system). This renewal or increase is measured in terms of the number of cells showing new-onset expression of markers associated with differentiation. This may be accomplished by introduction of the genetic vectors into the organ system using methods suitable for that purpose (see examples).

In a preferred embodiment, endogenous cells (e.g. ependymal zone cells of the central nervous system) are transfected in vivo with genetic vectors encoding the long numb isoform(s) and/or other transgenes (or their corresponding proteins) named herein, in order to transiently promote renewed or increased stem cell proliferation (with subsequent differentiation of progeny cells). This renewal or increase is measured in terms of the number of cells showing new-onset expression of markers associated with dividing progenitors. This may be accomplished by introduction of the genetic vectors into the organ system using methods suitable for that purpose (see examples).

Likewise, this approach is also be suitable for inducing renewed or increased differentiation from other stem cell populations in other tissues (such as the skin, etc.). This approach can be utilized, for example, clinically in the setting of central nervous system injury, disorders of other tissues where normal differentiation or migration are inadequate, dysplastic disorders and other disorders where the approach is beneficial.

In a preferred embodiment, in order to produce developmental activation, nucleic acid(s) or protein(s) corresponding to a single gene, or portion thereof, (particularly those named herein, discovered according to methods described herein, discovered according to other published methods; and/or known to be capable of initiating the desired manner of differentiation) are the only nucleic acid(s) or protein(s) overexpressed and/or introduced to initiate differentiation in the selected cells.

In a preferred embodiment, in order to produce developmental activation, nucleic acid(s) or protein(s) corresponding to a single gene, or portion thereof, (particularly those named herein, discovered according to methods described herein, discovered according to other published methods; and/or known to be capable of initiating the desired manner of differentiation) are the only nucleic acid(s) or protein(s) overexpressed and/or introduced to initiate differentiation in the selected cells and the method utilized is electroporation, liposomes, nanocapsules, nanovaults, and/or another approach avoiding retroviral/lentiviral integration or other random alteration of the cell's genome.

In a separate preferred embodiment, in order to produce developmental activation, other nucleic acid(s), protein(s) or other transfectants can be utilized in concert with the nucleic acid(s) or protein(s) corresponding to a single gene, or portion thereof, (particularly those named herein, discovered according to methods described herein, discovered according to other published methods; and/or known to be capable of initiating the desirable manner of differentiation) so long as a population of differentiating cells is produced from the selected cells.

In a separate preferred embodiment, in order to produce developmental activation, other nucleic acid(s), protein(s) or other transfectants can be utilized in concert with the nucleic acid(s) or protein(s) corresponding to a single gene, or portion thereof, (particularly those named herein, discovered according to methods described herein, discovered according to other published methods; and/or known to be capable of initiating the desirable manner of differentiation) so long as a population of differentiating cells is produced from the selected cells and the method utilized is electroporation, liposomes, nanocapsules, nanovaults, and/or another approach avoiding retroviral/lentiviral integration or other random alteration of the cell's genome.

It is to be understood that any combination of nucleic acids or proteins described herein can be modified by excluding those corresponding to Numb and/or Numblike so long as the desired cell population or behavior is achieved.

Similarly, it should be understood that the methods described herein (or elsewhere) for initiating differentiation are applicable to any induced or non-induced multipotent, pluripotent, or self-renewing stem cells, or other selected cells, not only those obtained in the manner described herein.

Sources of Selected Cells

The population of selected cells may derive from various stem cells, progenitor cells and somatic cells. However somatic cells lacking nuclei (e.g. mature, human red blood cells) are specifically excluded. Selected stem cells may be derived from existing cell lines or isolated from stored, banked, or cryopreserved sources. Typical sources of stem cells include bone marrow, peripheral blood, placental blood, amniotic fluid (e.g. De Coppi et al., 2007), umbilical cord blood (e.g. Zhao, et al., 2006; Tian et al., 2007), adipose tissue (e.g. Gimble et al., 2007; Ma et al., 2007), non-human embryos, and others. Circulating leukocytes and other non-stem cells may likewise be selected and subjected to the same culture conditions as described above effective that they acquire multipotency, pluripotency and/or self-renewal as a result. Examples of other accessible somatic cells useful in this invention include lymphocytes and epithelial (e.g. buccal cheek) cells. Isolation and collection of cells selected for use within the present invention may be performed by any method known to the art.

In embodiments involving animals, stem cells isolated from prostate, testis, embryonic brain, and intestine are also disclosed as being preferred sources of selected cells.

In a preferred embodiment, the selected cells and/or their progeny are cultured in a three-dimensional format.

A further aim of the present invention is to provide cells for use in the production of patient-compatible and patient-specific tissues and organs for transplantation to patients or subjects deemed to be requiring such organs or tissues. It is disclosed herein that the pluripotent, multipotent, and/or differentiating cells provided by the methods described herein (or similar methods) be utilized in conjunction with techniques aimed at the production of such organs and/or tissues (e.g. Boland et al., 2006. Xu et al., 2006; Campbell and Weiss, 2007). Such utilization is specifically covered by the present invention.

For instance, pluripotent, multipotent, and/or differentiating cells produced or treated according to the methods desribed herein (or other published methods) may be grown in association with three-dimensional or two-dimensional scaffoldings engineered to replicate normal tissue structure and/or organ structures (e.g. Yarlagada et al., 2005; Kim et al, 1998; WO/2003/070084; EP1482871; WO03070084; U.S. Pat. Nos. 2,395,698; 7,297,540; 6,995,013; 6,800,753; Isenberg et al., 2006).

Similarly, scaffoldings to be occupied by the pluripotent, multipotent, and/or differentiating cells may be derived from cadaveric organ(s) or tissue(s) after the cadaveric organs or tissues (e.g. bone, target tissue, organ or cavity, kidney, liver, lung, etc.) may be treated in such away that the host immune cells resident in that tissue, and other undesirable or ancillary host cells, are eliminated (e.g. by ionizing radiation, sterilization (e.g. Mroz et al., 2006), and/or various methods of decellularization (U.S. Pat. Nos. 6,734,018; 6,962,814; 6,479,064; 6,376,244; 5,032,508; 4,902,508; 4,956,178; 5,281,422, 5,554,389; 6,099,567; and 6,206,931; 4,361,552 and 6,576,618; 6,753,181; U.S. application Ser. No. 11/162,715; WO/2001/048153; WO/2002/024244; WO003002165; WO/2001/049210; WO/2007/025233; European Patents EP1482871; EP1246903; EP1244396; EP0987998; EP1244396; EP1333870; Rieder et al., 2004; Ott et al., 2008; Taylor et al., 1998)).

Likewise, it is anticipated that the pluripotent, multipotent, and/or differentiating cells of the present invention may be used in applications utilizing inkjet-style printing for tissue engineering (e.g. Boland et al., 2006. Xu et al., 2006; Campbell et al., 2007). Therefore, such use of the cells produced or treated according to the methods described herein is covered.

In another preferred embodiment, the selected cells and/or their progeny are cultured in hanging drops.

In accordance with another aspect of the present invention, selected cells may be modified genetically beforehand.

In accordance with another aspect of the present invention, selected cells may be modified with DNA or RNA encoding protein(s) or polypeptide(s) promoting differentiation of the cell into a desired cell population.

Screening Cell Populations

In one embodiment, the methods of this invention comprise screening cells from cell lines, donor sources, umbilical cord blood, and autologous or donor bone marrow, blood, spermatogonia, primordial germ cells, buccal cheek cells, or any other cell source effective in the current invention. Selected cells can be screened to confirm successful transfection with (or overexpression of) beneficial sequence(s) or therapeutic vector(s) as well as successful initiation of differentiation by any method known to the art (Guan et al., 2006; U.S. Pat. No. 6,432,711). In some embodiments, the cells are screened using standard PCR and nucleic acid hybridization-based methods or using rapid typing methods. In preferred embodiments, the cells are screened according to expression of reporter genes. In some embodiments, cells are screened by expression of a marker gene encoded by the transgene expressing vector(s) such as an antibiotic resistance gene or a fluorescent protein (e.g. GFP) gene.

Screening for Therapeutic Vectors and Beneficial Sequences

Cells can be screened for the presence of beneficial sequence(s) and therapeutic vector(s) using any method(s) known to the art for detection of specific sequences. Each cell sample can be screened for a variety of sequences simultaneously. Alternatively, multiple samples can be screened simultaneously.

Cell differentiation may be monitored by several means: including (i) morphological assessment, (ii) utilizing reverse transcriptase polymerase chain reaction (RT-PCR), Northern blot, or microarray techniques to monitor changes in gene expression, (iii) assaying cellular expression of specific markers such as beta tubulin III (for neurons) etc. (Ozawa, et al., 1985). In some embodiments, the cells are screened for successful initiation of differentiation using FACS sorting based on cell type specific markers or transgenic marker expression (e.g. antibiotic resistance or fluorescent protein expression) under the control of cell type specific promoters such as the myosin promoter in muscle cells; the human cardiac α-actin promoter in cardiomyocytes; the insulin promoter in insulin producing cells; the neuronal-specific enolase (NSE) promoter for neuronal differentiation, or neurotransmitter related promoters such as the tyrosine hydroxylase promoter in dopaminergic neurons; etc.).

In some embodiments, the cells are screened using standard PCR and nucleic acid hybridization-based methods. In a particularly preferred embodiment, the cells are screened using rapid typing methods.

Screening for Human Leukocyte Antigen (HLA) Type

In certain embodiments, the selected cells are selected with respect to compatible HLA typing. The HLA genotype can be determined by any means known to those of skill in the art.

The cells used for screening may consist of cells taken directly from a donor, or from cell lines established from donor cells, or other practicable cell sources. The cells can be screened for beneficial sequence(s), and/or therapeutic vector(s) and HLA type at once, or separately. Those cells successfully transfected with a beneficial sequence and showing an appropriate HLA genotype can be prepared for transplantation to a patient.

In certain embodiments, the transfected cells are transplanted without HLA typing. In other embodiments, the cells are HLA typed for compatibility.

Screening for Agents Promoting a Cellular Phenotype.

The present invention also provides for a methods of screening proteins and agents for their ability to produce developmental activation of the selected cells and/or their progeny into desired cell populations. Briefly, vectors encoding complementary DNAs (cDNAs) from appropriate cDNA libraries are transfected into the selected cells/and or their progeny. Once a specific cDNA that induces differentiation or other phenotypic change is identified, such cDNA then may be isolated and cloned into an appropriate expression vector for protein production in appropriate cells (e.g. COS cells) in vitro. Later the protein containing supernatant can be applied to the selected cell cultures to determine if any secreted proteins from such cells induce differentiation Alternatively, candidate agents can be applied to the selected cell cultures to determine if any of the candidates induce developmental activation.

The present invention also provides for methods of screening nucleic acids for their ability to induce multipotentiality, pluripotentiality, and/or self-renewal, or to initiate differentiation of selected cells and/or their progeny. In these methods, vectors encoding selected cDNAs (or cDNAs from appropriate cDNA libraries, or other sequences are introduced into the selected cells/and or their progeny using electroporation, nanocapsules, nanovaults, liposomes, retroviruses, lentiviruses, and/or any other practicable means of transfection. Once a specific cDNA that induces a phenotypic change, multipotentiality, pluripotentiality, and/or self-renewal, is identified, such cDNA then may be isolated and cloned into an appropriate expression vector.

Assays for determining such changes include those described elsewhere herein.

Likewise the protein corresponding to the identified cDNA may be produced in appropriate cells (e.g. COS cells) in vitro to determine whether the protein containing supernatant can be applied to the selected cell cultures and induce the desired changes.

Finally, proteins may be introduced into the selected cells/and or their progeny using electroporation, nanocapsules, nanovaults, liposomes, retroviruses, lentiviruses, and/or any other practicable means of transfection, and the resulting cells assessed as described herein for multipotentiality, pluripotentiality, self-renewal or the initiation of differentiation.

Tranplantation of Cells into Patients or Subjects

After screening, selected cells and/or their progeny may be cryopreserved, maintained as cell lines in culture, or may be administered to the patient. Selected cells can be cryopreserved or maintained in culture by any means known to the art and preserved for future transplantation procedures.

Preferably, the cells to be screened are obtained from accessible sources allowing easy collection.

With regard to producing HIV resistant cells: targeted somatic cells and stem cells of this invention can be of any type capable of differentiating into cells that can be infected by HIV, that can sustain the transcription and/or replication of HIV, that can alter the HIV immune response, or that can retard progression to AIDS. Such stem cells include, but are not limited to, pluripotent cells derived from spermatogonia, primordial germ cells, hematopoietic stem cells, peripheral blood cells, placental blood cells, amniotic fluid cells, umbilical cord blood cells, buccal cheek cells, adipose tissue cells (including stem cells derived from those tissues), reprogrammed cells, induced multipotent cells, induced pluripotent cells, etc., non-human embryos, and/or any other cell type that can form blood and immune cells, HIV target cells, and other cells.

Therapeutic vector(s) express "beneficial sequence(s)" intended to render transfected or infected cells less capable of sustaining HIV replication and transcription. The genetic vector expressing "beneficial sequence(s)" as well as any virus derived from such genetic vector, are herein termed "therapeutic vector".

After screening, cells transfected with the desired therapeutic vector(s) and expressing beneficial sequence (with or without compatible HLA genotype) may be expanded ex vivo (in vitro) using standard methods to culture dividing cells and maintained as stable cell lines (U.S. Pat. Nos. 6,432,711 and 5,453,357 herein incorporated by reference). Alternatively, these cells can be administered to the patient and expanded in vivo.

Selected cells can be cryopreserved by any means known to the art and preserved for future transplantation procedures.

Transplantation of Desirable Cell Populations into Patients or Subjects

In certain embodiments, cell populations are enriched for stem cells prior to transplantation.

Various methods to select for stem cells are well known in the art. For example, cell samples can be enriched by fluorescently labeled monoclonal antibodies recognizing cell-surface markers of undifferentiated hematopoietic stem cells (e.g., CD34, CD59, Thyl, CD38 low, C-kit low, lin-minus) for sorting via fluorescence-activated cell sorting (FACS).

In other embodiments, a sample of the selected cells is transplanted, without enrichment.

In some embodiments, the endogenous stem cells of the bone marrow are eliminated or reduced prior to transplantation of the therapeutic stem cells. Therapeutic stem cells are defined as those stem cells containing beneficial sequence(s) or therapeutic vector(s).

In some embodiments, the transplantation process may involve the following phases: (1) conditioning, (2) stem cell infusion, (3) neutropenic phase, (4) engraftment phase, and (5) post-engraftment period.

In some embodiments, the endogenous stem cells that normally produce the desired cells (e.g. bone marrow stem cells) are eliminated or reduced prior to transplantation. Chemotherapy, radiation, etc. and/or methods analogous to those described in U.S. Pat. No. 6,217,867 may be used to condition the bone marrow for appropriate engraftment of the transplant. Finally, therapeutic stem cells may be transplanted into the patient using any method known to the art.

Sample Transgene Encoding Vectors

In one embodiment transfection with (or overexpression of) nucleic acid sequence(s) encoding transgenes is accomplished via viral transfection. The term "transgene encoding vector(s)" refers to the vectors incorporating the nucleic acid sequence(s) encoding transgenes named herein, especially encoding one or more transgenes named herein, as well as any additional sequences, synthetic oligonucleotides, etc., and any associated viral supernatant incorporating those vector sequences.

In one embodiment, the transgene encoding vector(s) comprise two or more transgenes named herein for producing developmental activation. See FIG. 1D.

The transgene encoding vector(s) may comprise an expression vector. Appropriate expression vectors are those that may be employed for transfecting DNA or RNA into eukaryotic cells. Such vectors include, but are not limited to, prokaryotic vectors such as, for example, bacterial vectors; eukaryotic vectors, such as, for example, yeast vectors and fungal vectors; and viral vectors, such as, but not limited to adenoviral (Lin et al., 2007) vectors, adeno-associated viral vectors, and retroviral vectors. Examples of retroviral vectors which may be employed include, but are not limited to, those derived from Moloney Murine Leukemia Virus, Moloney Murine Sarcoma Virus, and Rous Sarcoma Virus, FIV, HIV, SIV and hybrid vectors, including the episomal, integrase-deficient, non-integrating, $3^{rd}$ generation engineered lentiviral vectors (see FIG. 3D), described herein and/or described in references cited herein. Such vectors can be introduced safely without genomic integration or random alteration of the genome using electroporation and other methods taught herein.

It is disclosed that the transgene encoding vector(s) may be used to transfect cells in vitro and/or in vivo. Transfection can be carried out by any means known to the art, especially through virus produced from viral packaging cells. Such virus may be encapsidated so as to be capable of infecting a variety of cell types. Nevertheless, any encapsidation technique allowing infection of selected cell types and/or their progeny is practicable within the context of the present invention.

Design of Human Immunodeficiency Virus (HIV) Gene Therapy Vector(s)

The "therapeutic vector(s)" may incorporate an expression vector. Appropriate expression vectors are those that may be employed for transfecting DNA or RNA into eukaryotic cells. Such vectors include, but are not limited to, prokaryotic vectors such as, for example, bacterial vectors; eukaryotic vectors, such as, for example, yeast vectors and fungal vectors; and viral vectors, such as, but not limited to adenoviral (Lin et al., 2007) vectors, adeno-associated viral vectors, and retroviral vectors. Examples of retroviral vectors which may be employed include, but are not limited to, those derived from Moloney Murine Leukemia Virus, Moloney Murine Sarcoma Virus, and Rous Sarcoma Virus, feline immunodeficiency virus (FIV), HIV, simian immunodeficiency virus (SIV) and hybrid vectors, including the replication incompetent, integrase-deficient, 3$^{rd}$ generation, engineered, episomal, non-integrating lentiviral vectors (see FIG. 3D), described herein and/or described in references cited herein. Such vectors can be introduced safely without genomic integration or random alteration of the genome using electroporation and other methods taught herein.

It is disclosed herein that the therapeutic vector(s) may be used to transfect target cells in vitro and/or in vivo. Transfection can be carried out by any means known to the art, especially through virus produced from viral packaging cells. Such virus may be encapsidated so as to be capable of infecting CD34+ cells and/or CD4+ cells. However, in some instances, other cell types are transfected by means not involving the CD4 or CD34 proteins. Nevertheless, any encapsidation technique allowing infection of such cell types may therefore be included in the disclosure of the present invention.

Pseudotyping with different envelope proteins expands the range of host cells transducible by viral vectors and therapeutic vectors and allows the virus to be concentrated to high titers, especially when pseudotyped with the vesicular stomatitis virus envelope glycoprotein (VSV-G) (Li et al., 1998; Reiser et al., 2000).

Vector Construction

Viral vectors utilized in this invention may be of various RNA and DNA virus types, including hybrid vectors. Vectors may, for instance, be third-generation lentiviral vectors which include only a very small fraction of the native genome (Zufferey et al., 1998). Production of transgene encoding vector(s) may also involve self-inactivating transfer vectors (Zufferey et al., 1998; Miyoshi et al., 1998) eliminating the production of full-length vector RNA after infection of target cells.

Viral vectors may be utilized which are replication-incompetent due to failure to express certain viral proteins necessary for replication. However, the possibility exists that helper virus may enable therapeutic virus replication. This likelihood can be reduced by the use of vectors that are self-inactivating, as well as replication-incompetent and non-integrating, as described in references cited herein.

In a preferred embodiment, transgene sequences are driven by a ubiquitin promoter, U6 promoter, EF1alpha promoter, CMV promoter, regulable promoters and/or desired cell type specific promoters.

Figure 1B:
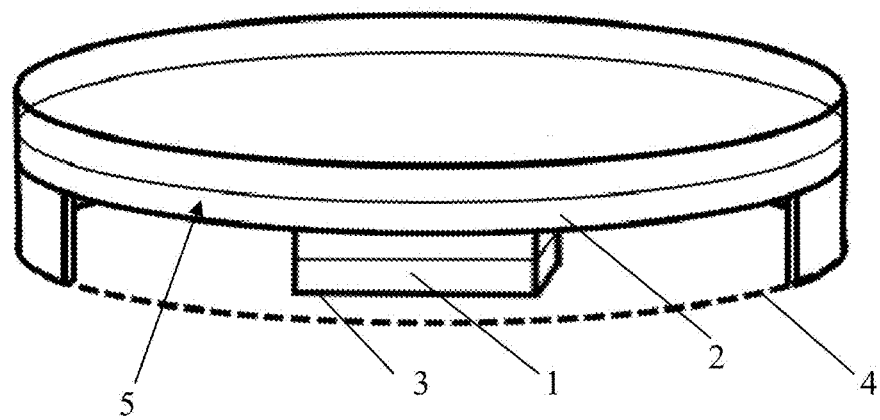
Figure 1C:
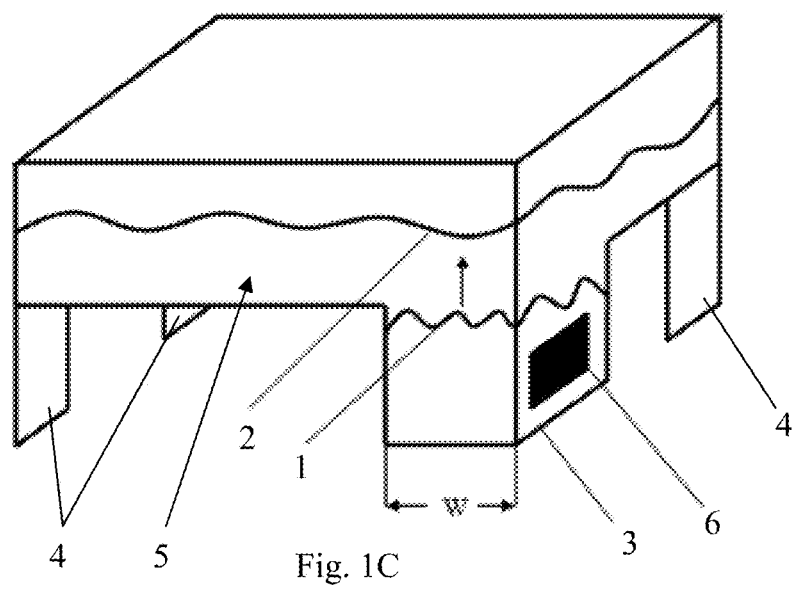
Figure 1D:
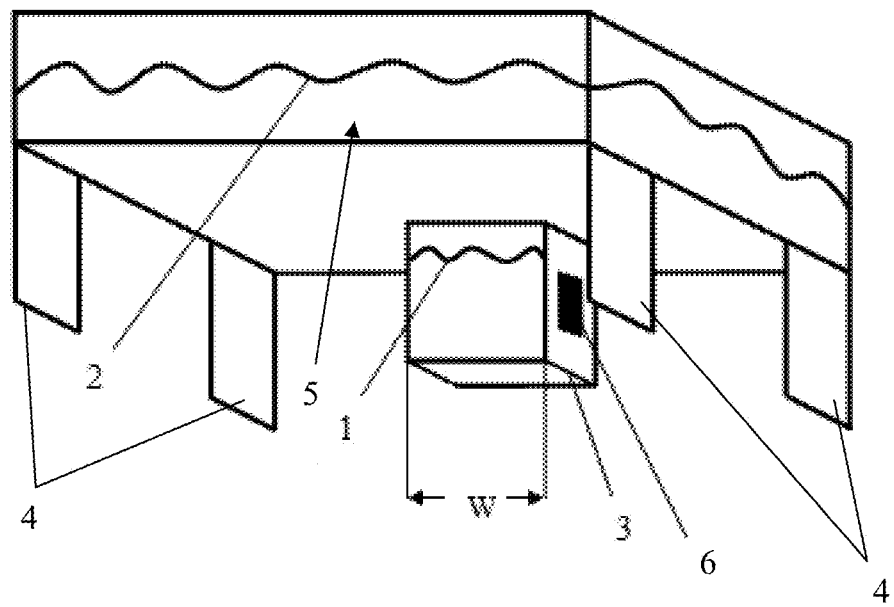
Figure 6A:
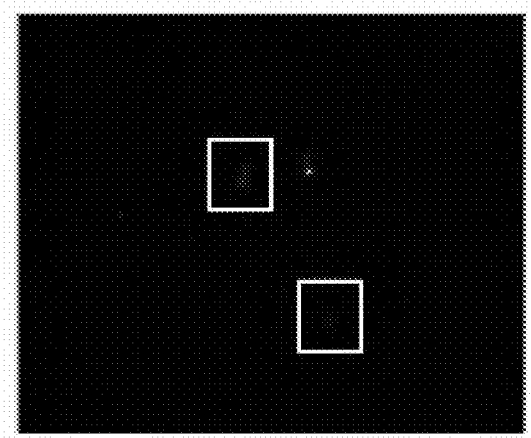
FIGS. 6A-D illustrate that cells transfected with Oct4, Sox2 and nanog proteins form colonies of VSEL-like cells that express pluripotent markers SSEA4 (FIG. 6B) and SSEA3 (FIG. 6D) as assessed by fluorescent immunohistochemistry.
Figure 6B:
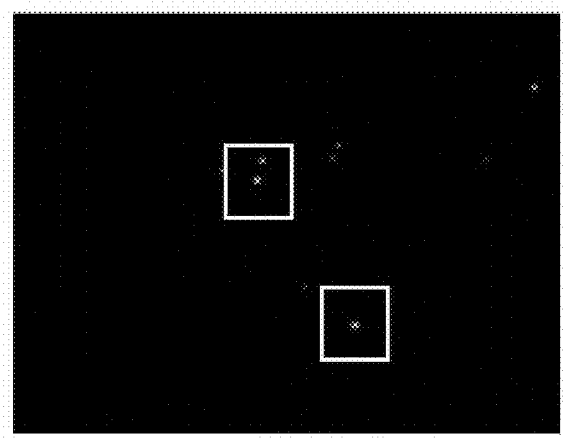
Figure 6C:
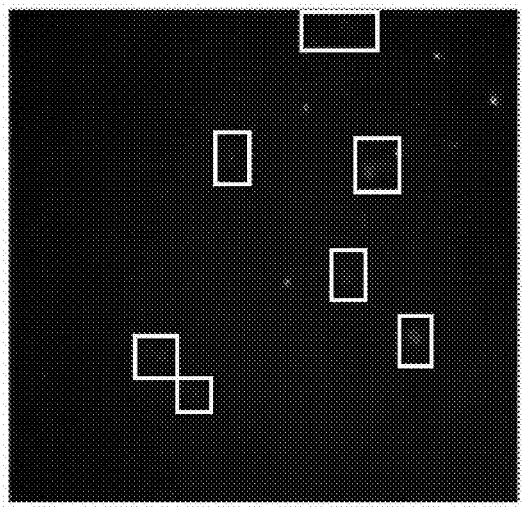
Figure 6D:
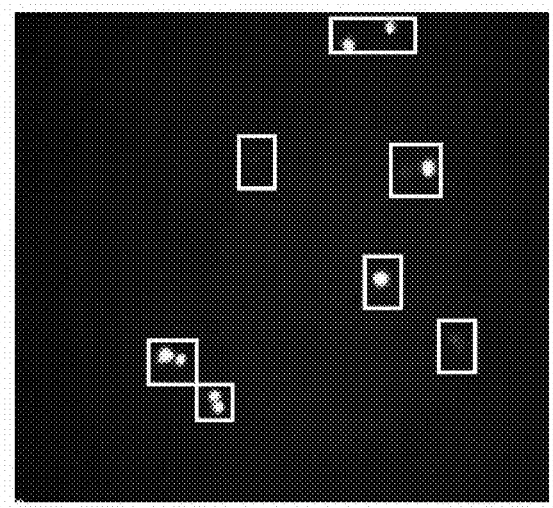

The lack of a functional integrase gene in these vectors renders them integrase-deficient and episomal, and is the consequence of inserting the EGFP expression cassette consisting of EGFP sequences and the CMV IE promoter into the region normally occupied the gag-pol genes (FIG. 6A of Reiser et al., 2000; see FIG. 1D herein).

When cell transduction is mediated by virus (i.e. viral particles) pol deletion interferes with reverse transcription of viral RNA to DNA. Accordingly, pol deletion results in a non-integrating or integration deficient lentivector. This is because "Integrase . . . is involved in the reverse transcription of HIV-1 RNA and nuclear import of the preintegration complex (PIC) (Gallay et al., 1997; Zhu et al., 2004; Philpott and Thraser, 2007).

However, when one skilled in the art chooses not to use infection and instead chooses electroporation to introduce DNA lentiviral vectors to the cells, as taught by the applicant, no reverse transcription is necessary; and because the pol gene is deleted, no integrase enzyme is present in the cell to support integration. It has been taught by Wanisch and Yanez-Munoz (2009) that, "HIV-1 circles are considerably stable after infection, with progressive vector episome dilution due to cell division. Thus, the apparent decrease in circularized HIV-1 DNA after infection of CD4+ MT-2 or SupT1 T-cells is the result of ongoing cell division causing the dilution of nonreplicating viral episomes in the cell population. Episomes are stable in macrophages for at least 21 days (ref. 36), while a turnover of episomes has been observed in vivo in human peripheral blood mononuclear cells over the course of several weeks, suggesting that they can be slowly degraded." (Wanisch and Yanez-Munoz, 2009).

Accordingly, those skilled in the art recognize that integration deficient lentivectors may persist episomally for weeks or more after electroporation.

Viral Tropism

In a preferred embodiment, virus derived from the transgene encoding vector(s), therapeutic vector(s) and/or other transgeneic vector(s) of this invention is pseudotyped with vesicular stomatitis virus envelope glycoprotein to enable concentration of the virus to high titers and to facilitate infection of CD34+ cells.

Sequence Selection

The use of any sequence with 70% or greater identity (or complementarity) to any sequence referred to a transgene sequence named herein (searchable using the Entrez-Pubmed database) is covered by the invention if utilized in the manner described in the present invention.

The current invention also relates in part to a genetic vector that includes sequences capable of markedly reducing the susceptibility of mammalian cells to infection by HIV 1 and HIV-2 viruses (both together referred to herein as HIV).

The current invention discloses the novel combination of synthetic oligonucleotides to reduce the expression of genes critical to the HIV/AIDS disease process.

The desirability of combining synthetic oligonucleotides to effect co-receptor "knock down" with expression of TAR and RRE decoy sequences arises from the proposition, expressed herein, that combining multiple gene therapy approaches simultaneously targeting 1) HIV infection, 2) HIV transcription, and 3) HIV replication in individual cells is likely to produce superior therapeutic benefits than any of these approaches in isolation.

Therapeutic vector(s) express "beneficial sequence(s)" intended to render transfected or infected cells less capable of sustaining HIV replication and transcription. The genetic vector expressing "beneficial sequence(s)" as well as any virus derived from such genetic vector, are herein termed "therapeutic vector".

The present invention is directed in part to the genetic modification of cells susceptible to infection by HIV or capable of propagating HIV. Such cells are herein termed "target cells".

In one embodiment, a cell comprising a mutation or deletion in the CCR5 and/or CCRX4 co-receptors, and/or other co-receptors is developmentally-activated according to the methods described herein to provide pluripotent cells, pluripotent like cells, multipotent cells, hematopoietic progenitors and stem cells, T cells and/or macrophages such that the resulting T cells and macrophages were HIV-resistant.

In a further embodiment, the CCR5 mutation or deletion is a 32 base pair deletion or other rendering the CCR5 gene non-functional.

In a further embodiment, CRISPR/CAS9 or other site-directed mutational methods known to the art to produce mutation or deletion in the CCR5 and/or CCRX4 co-receptors.

The present invention also provides a composition and method for using therapeutic viral vectors to reduce the susceptibility of mature or immature target cells, leukocytes, blood cells, any stem/progenitor cells, and/or their progeny (including DAdC) to infection by HIV.

It follows that the present invention also provides a composition and method for using therapeutic viral vectors to reduce the susceptibility of developmentally activated cells, induced cells, reprogrammed cells, induced multipotent cells, induced pluripotent cells, and/or their progeny to infection by HIV.

It is a further objective of this invention to reduce the ability of mature or immature target cells, stem/progenitor cells, (including developmentally activated cells, induced cells, reprogrammed cells, induced multipotent cells, induced pluripotent cells) and/or their progeny to sustain immunodeficiency virus replication and transcription.

It is another objective of this invention to achieve efficient, long-term expression of the therapeutic sequences in mature or immature target cells, other quiescent cells, stem/progenitor cells, and/or their progeny.

In one aspect, this invention provides a method for preventing or treating HIV infection. The method involves transplanting stem cells transfected with therapeutic vector(s) or sequence(s), into patients or subjects with HIV infection.

Beneficial sequence(s) may be ones that reduce the ability of HIV to infect a cell, transcribe viral DNA, or replicate within an infected cell, or which enhances the ability of a cell to neutralize HIV infection.

In certain embodiments, the beneficial sequence(s) represent synthetic oligonucleotide(s) which interfere with HIV entry, including one or more selected from siRNA, shRNA, antisense RNA or miRNA directed against any of the HIV co-receptors (including, but not limited to, CXCR4, CCR5, CCR2b, CCR3, and CCR1).

In a preferred embodiment, the therapeutic vector(s) includes synthetic oligonucleotides targeting one or more HIV co-receptors including CXCR4, CCR5, CCR1, CCR2, CCR3, CXCR6 and/or BOB.

In another preferred embodiment the therapeutic vector(s) includes synthetic oligonucleotides targeting the major HIV co-receptors CXCR4 and CCR5

In a further preferred embodiment, the therapeutic vector(s) includes synthetic oligonucleotides targeting one or more HIV enzymes such as HIV reverse transcriptase, integrase and protease.

Appropriate sequences for the synthetic oligonucleotides are those 1) predictable by computer algorithms to be effective in reducing targeted sequences, and 2) capable of successfully reduce the amount of targeted enzyme by >70% in standard quantitative RNA assays and in assays of enzymatic activity or to a lesser but therapeutic degree.

The phrase "targeted sequence" indicates that a particular sequence has a nucleotide base sequence that has at least 70% identity to a viral genomic nucleotide sequence or its complement (e.g., is the same as or complementary to such viral genomic sequence), or is a corresponding RNA sequence.

In particular embodiments of the present invention, the term indicates that the sequence is at least 70% identical to a viral genomic sequence of the particular virus against which the oligonucleotide is directed, or to its complementary sequence.

Any of the various types of synthetic oligonucleotides may be expressed via therapeutic vector transfection, and the current invention is directed to all possible combinations of such oligonucleotides.

In a preferred embodiment, the synthetic oligonucleotide sequences are driven by target cell, specific promoter(s).

In another preferred embodiment, the synthetic oligonucleotide sequences are driven by U6 promoter(s).

Synthetic oligonucleotides, by the same token, may be included in the same therapeutic vector(s) with decoy RNA.

Decoy RNA

Decoy RNA are sequences of RNA that are effective at binding to certain proteins and inhibiting their function.

In a preferred embodiment, the therapeutic vector(s) comprise(s) multiple decoy RNA sequences.

In a further embodiment the decoy RNA sequences are flanked by sequences that provide for stability of the decoy sequence.

In another preferred embodiment the decoy RNA sequences are RRE and/or TAR decoy sequences (or their corresponding proteins).

In a preferred embodiment, the RRE and TAR decoy sequences are HIV-2 derived TAR and RRE sequences (or their corresponding proteins).

In another preferred embodiment the decoy sequences also include Psi element decoy sequences (or their corresponding proteins).

In a preferred embodiment, the decoy sequences are each driven by a U6 promoter.

In another preferred embodiment, the decoy sequences are driven by target-cell specific promoters.

In a preferred embodiment, the therapeutic vector targets multiple stages of the HIV life cycle by encoding synthetic nucleotide sequence(s) in combination with HIV-2 TAR and/or RRE decoy sequences (or their corresponding proteins).

In another preferred embodiment, the vector includes miRNA oligonucleotide sequences (or their corresponding proteins).

In another preferred embodiment, the vector includes shRNA oligonucleotide sequences (or their corresponding proteins).

In another preferred embodiment, the vector includes siRNA oligonucleotide sequences (or their corresponding proteins).

In another preferred embodiment, the vector includes RNAi oligonucleotide sequences (or their corresponding proteins).

In another preferred embodiment, the vector includes ribozyme sequences (or their corresponding proteins).

In another preferred embodiment, the vector includes a combination of synthetic oligonucleotide classes.

In a further embodiment, the synthetic nucleotide sequences target HIV co-receptors such as CCR5, CXCR4, etc.

In a further embodiment, the synthetic nucleotide sequences target HIV enzymes such as integrase, protease, reverse transcriptase, TAT, etc.

In a further embodiment, the ribozyme sequences target HIV co-receptors such as CCR5, CXCR4, etc., or HIV enzymes such as integrase, protease, reverse transcriptase, TAT, etc.

In a preferred embodiment, virus is generated using the therapeuic vector(s) and the virus is pseudotyped.

In a preferred embodiment, virus is generated using the therapeuic vector(s) and the virus is not pseudotyped and the virus shows native HIV tropism.

In a preferred embodiment, the therapeutic vector(s) is a viral vector.

In a preferred embodiment, the therapeutic vector(s) is a lentiviral vector.

In a preferred embodiment, the therapeutic vector(s) is a third-generation lentiviral vector.

In a preferred embodiment, the therapeutic vector(s) includes a combination of synthetic oligonucleotide classes.

In a preferred embodiment, synthetic nucleotide sequence expression is driven by the EF-1 alpha promoter or other target-cell appropriate promoters.

In a preferred embodiment, synthetic nucleotide sequence expression is driven by the U6 promoter or other target-cell appropriate promoters.

In a preferred embodiment, synthetic nucleotide sequence expression is driven by a combination of EF-1 alpha and U6, and/or other target-cell appropriate promoters.

In a preferred embodiment, EF-1 alpha drives miRNA expression while the U6 promoter drives RNA decoy expression.

In a preferred embodiment, EF-1 alpha drives siRNA sequence expression while the U6 promoter drives RNA decoy expression.

In a preferred embodiment, EF-1 alpha drives shRNA sequence expression while the U6 promoter drives RNA decoy expression.

In a preferred embodiment, the therapeutic vector(s) include synthetic oligonucleotides (e.g. multiple miRNA sequences)) directed against CXCR4, multiple sequences directed against CCR5, an HIV-2 RRE decoy sequence and an HIV-2 TAR decoy sequence, and the vector is a viral vector. See FIG. 15.

In a preferred embodiment, treatment involving the therapeutic vector(s) is combined with other modes of antiretroviral therapy including pharmacological therapies. Antiretroviral therapies appropriate for combination with the therapeutic vector(s) are those that have additive or synergistic effects in combination with the therapeutic vector.

Cells targeted for gene therapy in HIV may include, but are not necessarily be limited to mature peripheral blood T lymphocytes, monocytes, tissue macrophages, T cell progenitors, macrophage-monocyte progenitor cells, and/or multipotent hematopoietic stem cells, such as those found in umbilical cord blood, peripheral blood, and occupying bone marrow spaces.

The present invention also relates to transfection of CD4+ T cells, macrophages, T cell progenitors, macrophage-monocyte progenitors, CD 34+ stem/progenitor cells and/or any other quiescent cell, dividing cell, stem cell or progenitor cell capable of differentiation in vitro or in vivo into HIV target cells, CD4+ T cells, macrophages, T cell progenitors, macrophage-monocyte progenitors, and/or CD 34+ stem/progenitor cells. Transfected cells, therefore, can be endogenous cells in situ, or exogenous cells derived from other body regions or even other individual donors. Cells selected for this purpose are herein termed "selected cells".

By the same token, self-renewing, multipotent and/or pluripotent stem cells (including reprogrammed and induced pluripotent cells) represent another logical target for HIV gene therapy, and their use is specifically covered by the present invention.

In one embodiment of this process, selected cells (e.g. hematopoietic stem cells, skin stem cells, umbilical cord cells, primordial germ cells (PGCs), spermatogonia, any accessible somatic cell, etc.) are 1) propagated in culture using one or more cytokines such as steel factor, leukemia inhibitory factor (LIF), cardiotropin-1, IL-11, IL-6, IL-6 R, GP-130, CNTF, IGF-I, bFGF, and/or oncostatin-M and 2) transfected with the therapeutic vector(s) or beneficial sequence(s) prior to differentiation using any methods known to the art, such as those described in U.S. Pat. No. 5,677,139 herein incorporated by reference, or by methods analogous to U.S. Pat. No. 5,677,139 with respect to other target cells.

In separate embodiments, it may be desirable to perform the various steps prior to transfection.

In separate embodiments, for the purpose of generating pluripotent stem cell populations, it may be desirable to perform only the incubation steps above.

Appropriate concentrations of LIF and steel factor for stem/progenitor cell propagation/proliferation as well as other cell culture conditions have been described previously (e.g. U.S. Pat. Nos. 6,432,711 and 5,453,357 herein incorporated by reference). Other appropriate protocols and reference cytokine concentrations have been taught by Koshimizu et al., 1996; Keller et al., 1996; Piquet-Pellorce, 1994; Rose et al., 1994; Park and Han, 2000; Guan et al., 2006; Dykstra et al., 2006).

The population of target cells may include somatic cells, stem cells and progenitor cells. Stem cells may be derived from existing cell lines or isolated from stored, banked, or cryopreserved sources. Typical sources of stem cells include marrow, peripheral blood, placental blood, amniotic fluid, umbilical cord blood, adipose tissue, non-human embryos, etc.

Somatic cells, especially circulating leukocytes and other non-progenitor/stem cells may likewise be subjected to the same culture conditions as described above for stem/progenitor cells effective that they acquire stem/progenitor cell properties as a result.

The invention also discloses the production (e.g. US Patent Application 20030099621) of target cells from stem/progenitor cells that may be made relatively resistant to HIV infection and/or HIV replication.

It is understood, however, that any method of differentiating previously propagated stem/progenitor/leukocyte cells into the desired target cells may be employed within the scope of the invention so long as functional target cells relatively resistant to HIV infection and/or HIV replication/ and/or HIV transcription are produced.

In a preferred embodiment, the therapeutic viral vector is packaged with one or more envelope proteins from native HIV viruses conferring upon the therapeutic virus the capacity to infect any cell that native HIV strains are capable of infecting.

Cells selected for use in this invention wll be in some instances accessible (e.g. umbilical cord stem cells, bone marrow stem cells, spermatogonia and primordial germ cells of the testis, stem cells isolated from amniotic fluid, stem cells isolated from the skin, etc.). Such cells can be isolated from the tissues in which they reside by any means known to the art.

Other selected cells may comprise reprogrammed cells, induced multipotent cells, induced pluripotent cells, etc.

In accordance with an aspect of the present invention, there is provided a method of producing a desired cell line, cell type, or cell class from the selected cells. Generally, the method comprises culturing the selected cells and/or their progeny under conditions which promote growth of the selected cells at an optimal growth rate. The resulting cell population is then cultured under conditions which promote cell growth at a rate which is typically less than the optimal rate, and in the presence of an agent promoting differentiation of the cells into the desired cell line, cell type, or cell class (e.g. CD4+ T cells).

The present invention also discloses the propagation of the selected cells and/or their progeny in culture, before or after transfection with (or overexpression of) the therapeutic vector, by any means known to the art (e.g. US Patent Application 20060099177). Such methods also include incubation with LIF, steel factor, Il-6, IL-7, oncostatin-M and/or cardiotropin-1 and other growth enhancing cytokines, etc.

The present invention further discloses the directed differentiation of cells transfected with the therapeutic vector(s) into desired cell types by further incubation in media containing the appropriate cytokines and growth factors such as colony stimuating factors such as M-CSF (CSF-1), GM-CSF, IL-7, any cytokine promoting CD4+ T cell differentiation, etc.

Transfection

Genetic modification of selected cells and target cells, whether they be exogenous cells or endogenous cells can be performed according to any published or unpublished method known to the art (e.g. U.S. Pat. Nos. 6,432,711, 5,593,875, 5,783,566, 5,928,944, 5,910,488, 5,824,547, CRISPR/CAS9, etc.) or by other generally accepted means. Suitable methods for transforming host cells can be found in Sambrook et al. (Molecular Cloning: A Laboratory Manual, 2nd Edition, Cold Spring Harbor Laboratory press (1989)), and other laboratory textbooks.

Successfully transfected cells can be identified by selection protocols involving markers such as antibiotic resistance genes in addition to RNA expression assays and morphological analyses. Clones from successfully transfected cells, expressing the appropriate exogenous DNA at appropriate levels, can be preserved as cell lines by cryopreservation (utilizing any appropriate method of cryopreservation known to the art).

Selectable markers (e.g., antibiotics resistance genes) may include those which confer resistance to drugs, such as G418, hygromycin, ampicillin and blasticidin, etc. Cells containing the gene of interest can be identified by drug selection where cells that have incorporated the selectable marker gene survive, and others die.

A theoretical basis for the embodiments of the invention is described herein, however, this discussion is not in any way to be considered as binding or limiting on the present invention. Those of skill in the art will understand that the various embodiments of the invention may be practiced regardless of the model used to describe the theoretical underpinnings of the invention.

The invention will now be described and illustrated with respect to the following examples; however, the scope of the present invention is not intended to be limited thereby.

Example 1: Construction of the Transgenic Vectors Suitable for Use in the Present Invention Suitable EGFP-Numb and EGFP-Numblike, and EGFP-X lentiviral vectors (where X is any transgene described in the present invention) can be produced by cloning into an appropriate viral vector (e.g. the two-gene HIV-EGFP-HSA vector (Reiser et al., 2000)). Adapter primers can be selected for PCR amplification of Numblike and Numb isoform cDNAs and cloning into a genetic vector. In preparation for cloning, the gene vector is digested with enzymes. Subsequently, the cDNA for each transgene is inserted into the nef coding region previously occupied by the HSA cDNA-EGFP (enhanced green fluorescent protein) and a cell population-appropriate promoter (e.g. CMV ie or EF1alpha) having been previously inserted into the viral, gag-pol coding region. The lack of a functional integrase gene in these vectors renders them integrase-deficient and episomal, and is the consequence of inserting the EGFP expression cassette consisting of EGFP sequences and the CMV IE promoter into the region normally occupied the gag-pol genes (FIG. 6A of Reiser et al., 2000; see FIG. 3D herein). Such integrase-deficient vectors can be readily introduced using a variety of standard transfection techniques (e.g. electroporation, chemically mediated transfection, fusogenic or non-fusogenic liposomes, lipofectamine, nanocapsules, nanovaults, etc.)—methods which allow high capacity integrase-deficient lentiviral vectors to be utilized without genomic integration and random alteration of the genome.

When cell transduction is mediated by virus (i.e. viral particles) pol deletion interferes with reverse transcription of viral RNA to DNA. Accordingly, pol deletion results in a non-integrating or integration deficient lentivector. This is because "Integrase . . . is involved in the reverse transcription of HIV-1 RNA and nuclear import of the preintegration complex (PIC) (Gallay et al., 1997; Zhu et al., 2004; Philpott and Thraser, 2007).

However, when one skilled in the art chooses not to use infection and instead chooses electroporation to introduce DNA lentiviral vectors to the cells, as taught by the applicant, no reverse transcription is necessary; and because the pol gene is deleted, no integrase enzyme is present in the cell to support integration. It has been taught by Wanisch and Yanez-Munoz (2009) that, "HIV-1 circles are considerably stable after infection, with progressive vector episome dilution due to cell division. Thus, the apparent decrease in circularized HIV-1 DNA after infection of CD4+ MT-2 or SupT1 T-cells is the result of ongoing cell division causing the dilution of nonreplicating viral episomes in the cell population. Episomes are stable in macrophages for at least 21 days (ref. 36), while a turnover of episomes has been observed in vivo in human peripheral blood mononuclear cells over the course of several weeks, suggesting that they can be slowly degraded." (Wanisch and Yanez-Munoz, 2009).

Accordingly, those skilled in the art recognize that integration deficient lentivectors may persist episomally for weeks or more after electroporation.

Genetic constructs may include a vector backbone, and a transactivator which regulates a promoter operably linked to heterologous nucleic acid sequences (or their corresponding proteins).

Examples of retroviral vectors which may be employed include, but are not limited to, those derived from Moloney Murine Leukemia Virus, Moloney Murine Sarcoma Virus, and Rous Sarcoma Virus, FIV, and HIV. Appropriate expression vectors are those that may be employed for transfecting DNA or RNA into eukaryotic cells. Such vectors include, but are not limited to, prokaryotic vectors such as, for example, bacterial vectors; eukaryotic vectors, such as, for example, yeast vectors and fungal vectors; and viral vectors, such as, but not limited to, lentiviral vectors, adenoviral (Lin et al., 2007) vectors, adeno-associated viral vectors, and retroviral vectors. See FIG. 1 as well as U.S. Provisional Application Ser. No. 60/932,020, filed May 29, 2007, U.S. Provisional Application Ser. No. 60/933,133, filed Jun. 5, 2007, U.S. Provisional Application Ser. No. 60/933,670, filed Jun. 8, 2007, U.S. Provisional Application Ser. No. 61/006,449, filed Jan. 14, 2008, U.S. Provisional Application Ser. No. 61/064,761, filed Mar. 25, 2008.

The replication incompetent pcDNA 6.2/EmGFP-Bsd/V5-DEST vector is an example of an appropriate expression vector (Invitrogen) and allows expression of synthetic oligonucleotides (e.g. miRNAs) transferred from the pcDNA 6.2 GW/miR vector that have the capacity to cleave targeted sequences (or their corresponding proteins). These vectors include flanking and loop sequences from endogenous miRNA to direct the excision of the engineered miRNA from a longer Pol II transcript (pre-miRNA).

Combining multiple miRNA sequences directed against specific endogenous RNA species increases the likelihood of success in reducing target sequence expression. miRNA sequences may be operably linked to regulable or tissue specific promoters.

By utilizing lentiviral vectors for gene expression, the resulting transgene encoding vector(s) and/or other transgenic vector(s) of this invention, becomes capable of stably transducing both dividing and non-dividing cell types.

Moreover, 2nd and 3d generation, integrase-deficient lentiviral vectors provide a non-integrating, episomal vector suitable, along with adenoviral (Lin et al., 2007), AAV, hybrid vectors, plasmid DNA, etc. for use in the present invention. (See FIG. 1D).

Figure 3A:
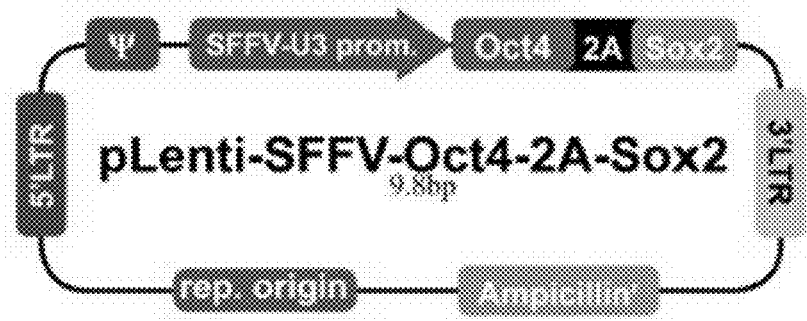
FIG. 3A is a schematized map of pLenti-SFFV-Oct4-2A-Sox2 vector.
Figure 3B:
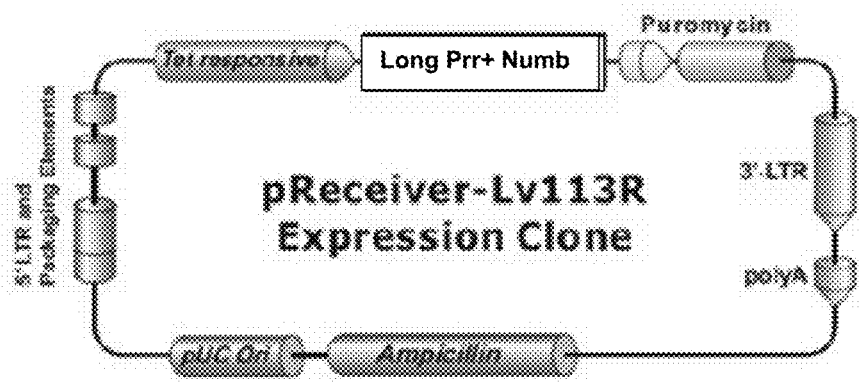
FIG. 3B is a schematized map of pLenti-pReceiver-Lv113R vector.
Figure 3C:
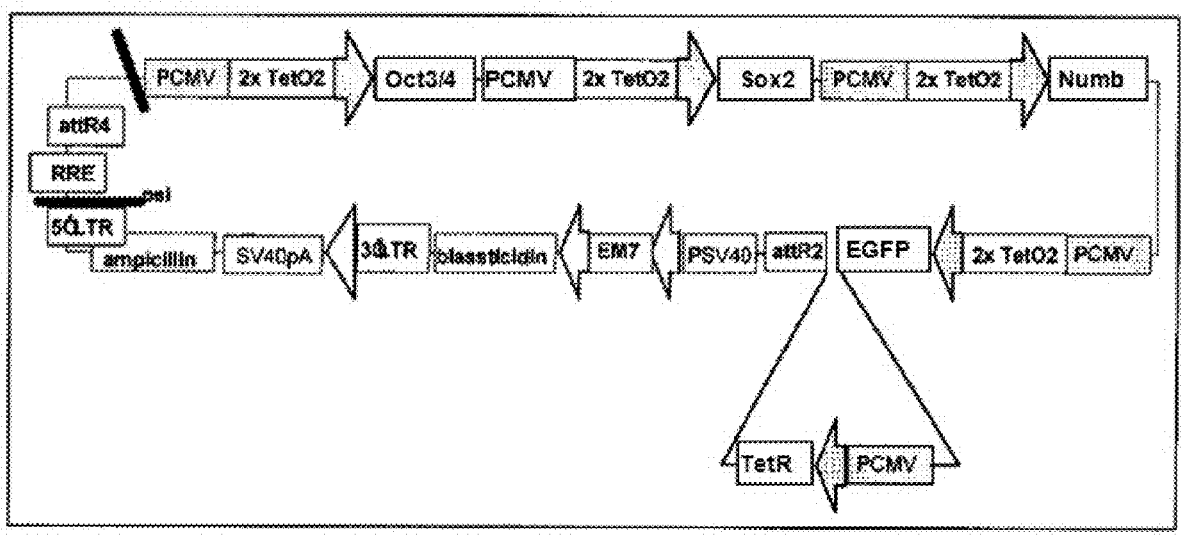
FIG. 3C is a schematized vector map corresponding to the vector sequence of Example 13.
Figure 3D:
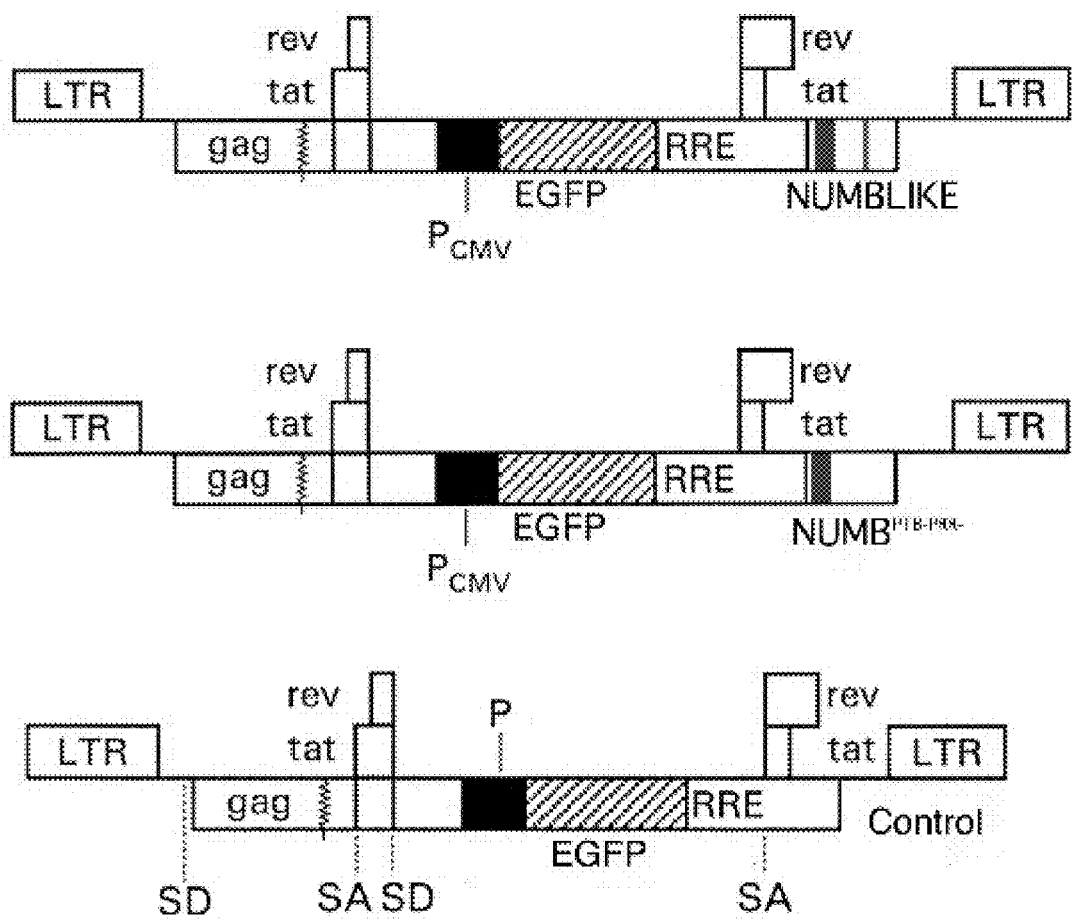
FIG. 3D shows a non-integrating, Numb and Numblike lentivectors.
Figure 4A:
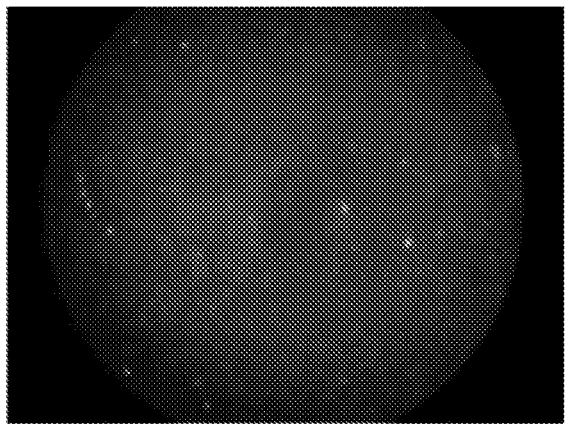
FIGS. 4A-4D illustrate 3T3 cells electroporated at 300V with a varying number of 5 ms pulses in the presence of FITC-conjugated albumin.
Figure 4B:
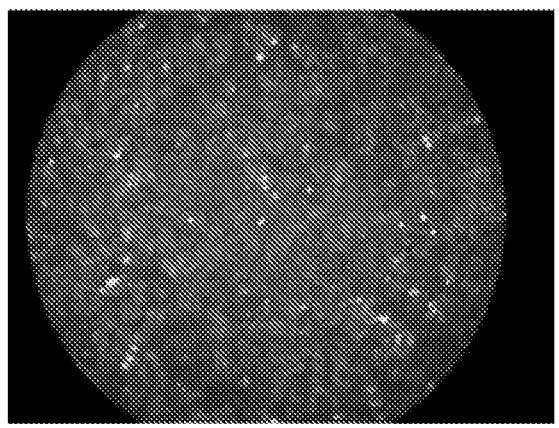
Figure 4C:
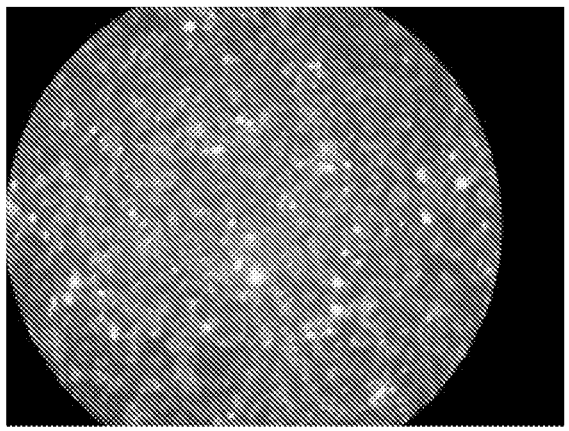
Figure 4D:
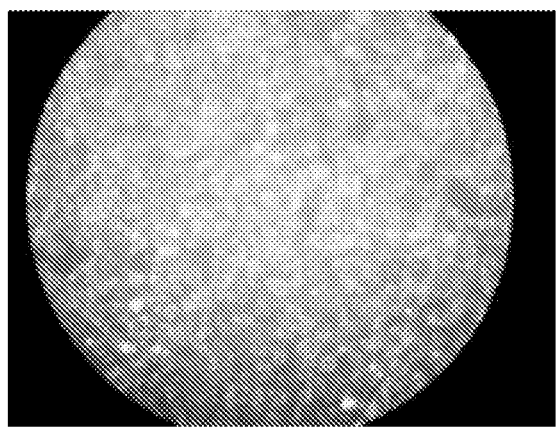
Figure 5A:
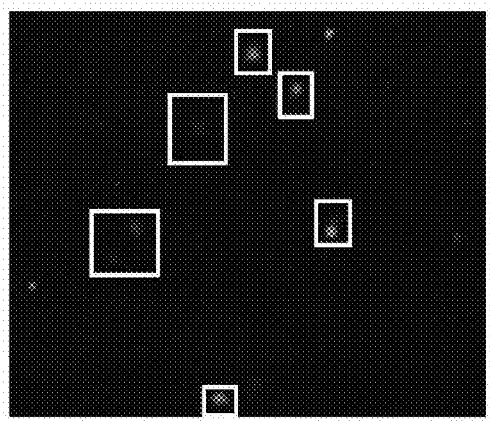
FIGS. 5A-D illustrate PRR+Numb transfected cells form colonies of VSEL-like cells that express pluripotent markers SSEA3 (FIG. 5B) and SSEA4 (FIG. 5D) as assessed by fluorescent immunohistochemistry.
Figure 5B:
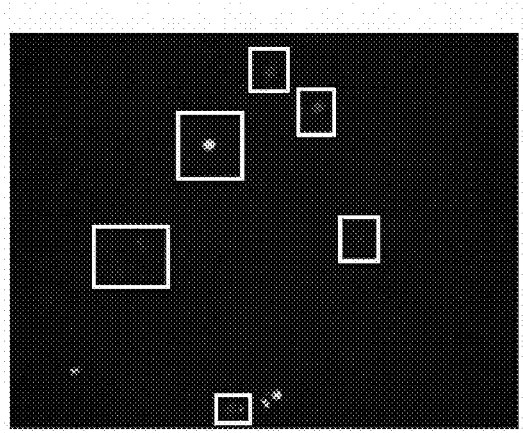
Figure 5C:
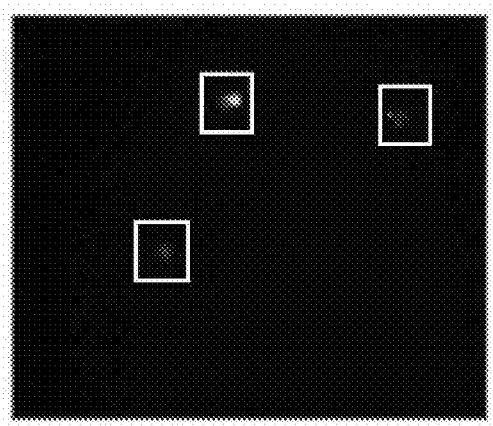
Figure 5D:
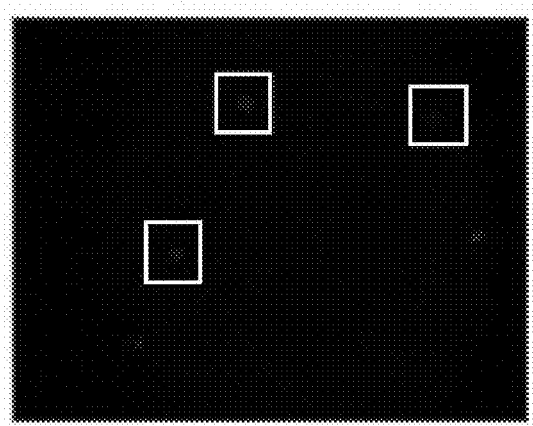

In a preferred embodiment, the resulting Numb/Numblike encoding vector(s), and/or other transgenic vector(s) of this invention contain multiple synthetic oligonucleotide sequences driven by one or more promoters so as to reduce expression of specific numb isoforms and/or numblike (FIG. 3D).

Example 2

Another example of a suitable vector is a retroviral vector. Retroviruses are RNA viruses that contain an RNA genome. The gag, pol, and env genes are flanked by long terminal repeat (LTR) sequences (or their corresponding proteins). The 5' and 3' LTR sequences promote transcription and polyadenylation of mRNAs.

The retroviral vector may provide a regulable transactivating element, an internal ribosome reentry site (IRES), a selection marker, and a target heterologous gene operated by a regulable promoter.

Alternatively, multiple sequences may be expressed under the control of multiple promoters. Finally, the retroviral vector may contain cis-acting sequences necessary for reverse transcription and integration. Upon infection, the RNA is reverse transcribed to DNA that integrates efficiently into the host genome. The recombinant retrovirus of this invention is genetically modified in such a way that some of the retroviral, infectious genes of the native virus have been removed and in certain instances replaced instead with a target nucleic acid sequence for genetic modification of the cell. The sequences may be exogenous DNA or RNA, in its natural or altered form.

Example 3: Example Methods for Generation of Numb/Numblike Encoding Vector(s), and/or Other Transgenic Vector(s) of this Invention The methods for generation of the resulting Numb/Numblike encoding vector(s), and/or other transgenic vector(s) of this invention include those taught in Invitrogen's Viral Power Lentiviral Expression Systems Manual, 2007. Briefly, the EmGFP-bsd cassette is cloned as a PmlI-BlpI fragment into the pLenti6/R4R2/V5-DEST vector, while the miR-long (PRR+) numb isoform or miR-short numb isoform/numblike cassettes are simultaneously transferred by BP reaction into pDONR221. Then the regulable promoter(s) and miR-isoform cassettes are Multi-site LR crossed into the modified pLenti6/EmGFP-bsd/R4R2-DESTvector.

Multiple vectors can be generated in this manner comprising different combinations of synthetic oligonucleotides and transgene cassettes.

The pLenti6/R4R2/V5-DEST vector sequence corresponds to (SEQ ID NO: 1).

Example 4: Additional Methods for Generation of Therapeutic Vector(s)

"Packaging cell lines" derived from human and/or animal fibroblast cell lines result from transfecting or infecting normal cell lines with viral gag, pol, and env structural genes. On the other hand, packaging cell lines produce RNA devoid of the psi sequence, so that the viral particles produced from packaging cell do not contain the gag, pol, or env genes. Once the therapeutic vector's DNA containing the psi sequence (along with the therapeutic gene) is introduced into the packaging cell, by means of transfection or infection, the packaging cell may produce virions capable of transmitting the therapeutic RNA to the final target cell (e.g. a CD4+ cell).

The "infective range" of the therapeutic vector(s) is determined by the packaging cell line. A number of packaging cell lines are available for production of virus suitable for infecting a broad range of human cell types. These packaging cell lines are nevertheless generally capable of encapsidating viral vectors derived from viruses that in nature usually infect different animal species. For example, vectors derived from SIV or MMLV can be packaged by GP120 encapsidating cell lines.

An example protocol for producing a therapeutic viral supernatant is provided as follows:

1. Twenty micrograms of retrovirus vector are mixed with 2-3 micrograms of viral DNA containing the selectable marker gene (e.g. antibiotic resistance gene) by gentle tapping in 0.8-1 milliliter of Hepes buffered saline (pH=7.05) in a 1.5 ml plastic tube.

2. Seventy microliters of 2M $CaCl^2$ are added to the mixture by repeated gentle tapping.

3. When a blue precipitate first begins to appear within the tube, the product should be gently applied to a 30% confluent layer of packaging cells (from any number of commercial vendors). The DNA mixture should be applied only after first removing the medium from the packaging cells.

4. The packaging cells are set to incubate for 20-30 minutes at room temperature (25 degrees Celsius) before transferring them back to an incubator at 36-38 degrees Celsius for 3.5 hours.

5. Add 3.5-4 milliliters of Hepes buffered saline containing 15% glycerol for 3 minutes then wash cell with Dulbecco's Modified Eagle's Medium (DMEM)+10% FBS×2.

6. Add back DMEM +10% FBS, and incubate cells for 20 hours at 37 degrees Celsius.

7. Remove and filter medium containing therapeutic viral particles.

Excess viral supernatant is immediately stored or concentrated and stored at −80 degrees Celsius). Supernatant may stored with 5-8 micrograms of polybrene to increase the efficiency of target cell infection. Otherwise polybrene may be excluded or added just before infection.

8. Stable producer lines can be established by splitting packaging cell lines 1 to 20, or 1 to 40 and subsequently incubating these cells for up to 10 days (changing medium every three days) in medium containing selective drugs (e.g. certain antibiotics corresponding to transfected resistance genes).

9. After 10 days isolated colonies are picked, grown-up aliquoted and frozen for storage.

Assay of Retrovirus Infectivity/Titration is achieved by application of a defined volume of viral supernatant to a layer of confluent "test" cells such as NIH 3T3 cells plated at 20% confluence. After 2-3 cell division times (24-36 hours for NIH 3T3 cells) colonies of "test" cells incubated at 37 degrees in antibiotic-containing medium are counted. The supernatant's titer are estimated from these colony counts by the following formula:

Colony Forming Units/ml=colonies identified×0.5
(split factor)/volume of virus (ml)

The accuracy of this estimate is increased by testing large volumes of supernatant over many plates of "test" cells.

Application of the therapeutic viral supernatant to target cells may be accomplished by various means appropriate to the clinical situation.

Example 5: Growth Medium for Selected Cells

Selected cells can be expanded/grown in Dulbecco's modified Minimal Essential Medium (DMEM) supplemented with glutamine, beta.-mercaptoethanol, 10% (by volume) horse serum, and human recombinant Leukemia Inhibitory Factor (LIF). LIF replaces the need for maintaining selected cells on feeder layers of cells, (which may also be employed) and is essential for maintaining selected cells in an undifferentiated, multipotent, or pluripotent state, such cells can be maintained in Dulbecco's modified Minimal Essential Medium (DMEM) supplemented with glutamine, beta.-mercaptoethanol, 10% (by volume) horse serum, and human recombinant Leukemia Inhibitory Factor (LIF). The LIF replaces the need for maintaining cells on feeder layers of cells, (which may also be employed) and is essential for maintaining cells in an undifferentiated state (per U.S. Pat. No. 6,432,711).

In order to initiate the differentiation of the selected cells into neuronal cells, the cells are trypsinized and washed free of LIF, and placed in DMEM supplemented with 10% fetal bovine serum (FBS). After resuspension in DMEM and 10% FBS, $1 \times 10^6$ cells are plated in 5 ml DMEM, 10% FBS, 0.5 microM retinoic acid in a 60 mm Fisher bacteriological grade Petri dishes, where the cells are expected to form small aggregates. Aggregation aids in proper cell differentiation. High efficiency transfection with (or overexpression of) appropriate neuronal transcription factors and small RNAs can occur before or after plating in DMEM, FBS, and retinoic acid. (See U.S. Pat. Nos. 6,432,711 and 5,453,357 for additional details).

Example 6

HLA matching. Selected cells (e.g. umbilical cord blood or cells from any other suitable source and/or their progeny), can be screened, genetically-modified (optional), expanded, and induced to begin differentiating into the desired cell type(s) (optional). The cells are then transplanted according to standard stem cell transplantation protocols. In certain instances, cells may be transplanted into patients or subjects without HLA matching.

Example 7

In some rare instances, it may be appropriate to introduce transgene encoding vectors into patients or subjects in order to stimulate or inhibit cellular division or cellular differentiation, in vivo (e.g. in cancer).

Example 8: Genetic Modification of Selected Cells

In vitro genetic modification of exogenous cells or patient's endogenous cells can be performed according to any published or unpublished method known to the art (e.g. U.S. Pat. Nos. 6,432,711, 5,593,875, 5,783,566, 5,928,944, 5,910,488, 5,824,547, etc.) or by other generally accepted means. Suitable methods for transforming host cells can be found in Sambrook et al. (Molecular Cloning: A Laboratory Manual, 2nd Edition, Cold Spring Harbor Laboratory press (1989)), and other laboratory textbooks.

Successfully transfected cells are identified by selection protocols involving markers such as antibiotic resistance genes in addition to RNA expression assays and morphological analyses. Clones from successfully transfected cells, expressing the appropriate exogenous DNA at appropriate levels, can be preserved as cell lines by cryopreservation (utilizing any appropriate method of cryopreservation known to the art).

Selectable markers (e.g., antibiotic resistance genes) may include those conferring resistance to drugs, such as G418, hygromycin and methotrexate. Cells containing the gene of interest can be identified by drug selection where cells that have incorporated the selectable marker gene survive, and others die.

The current invention discloses the selection of genetically-modified cells as "selected cells" of the invention. The term genetic modification refers to alteration of the cellular genotype by introducing natural or synthetic nucleic acids into selected cells and/or their progeny or immortalized cell lines and/or their progeny by any means known to the art. Alternatively culture conditions that induce permanent changes in gene expression patterns are considered herein to represent genetic modification. Modification of stem cells, whether they be derived from the host brain, endogenous donor sources, exogenous donor sources, or cell lines, represents a feasible approach to the treatment of certain human diseases, especially those of the human nervous system.

Genetic modifications covered by this disclosure include, but are not limited to: genetic modifications performed in vivo; modifications that alter the activity or amount of metabolic enzymes expressed by endogenous or exogenous selected cells and/or their progeny; modifications which alter the activity, amount, or antigenicity of cellular proteins; modifications which alter the activity or amount of proteins involved in signal transduction pathways; modifications which alter HLA type; modifications which alter cellular differentiation; modifications which alter neoplastic potential; modifications which alter cellular differentiation; modifications which alter the amount or activity of structural proteins; modifications which alter the amount or activity of membrane associated proteins (structural or enzymatic); modifications which alter the activity or amount of proteins involved in DNA repair and chromosome maintenance; modifications which alter the activity or amount of proteins involved in cellular transport; modifications which alter the activity or amount of enzymes; modifications which alter the activity or amount of proteins involved in synapse formation and maintenance; modifications which alter the activity or amount of proteins involved in neurite outgrowth or axon outgrowth and formation; modifications altering the amount or activity of antioxidant producing enzymes within the cell; modifications which lead to altered post-translational modification of cellular proteins; modifications which alter the activity or amount of proteins involved in other aspects of cellular repair, and alterations which increase the lifespan of the cell (such as production of telomerase). Such proteins as those mentioned above may be encoded for by DNA or RNA derived from the human genome or other animal, plant, viral, or bacterial genomes. This invention also covers sequences (or their corresponding proteins) designed de novo.

In addition, this invention relates to the in situ, genetic modification of selected cells and/or their progeny cells for the treatment of disease. Endogenous stem cells may be modified in situ by direct injection or application of DNA or RNA vectors, including viruses, retroviruses, liposomes, etc., into the substance of the tissue or into the appropriate portion of the ventricular system of the brain. Since 1992, we have modified thousands of stem/progenitor cells and many thousand progeny cells in this manner. Our data shows that this manner of modifying progenitor cells results in a tremendous variety of modified cell types throughout the nervous system, and has never resulted in adverse effects.

Example 9: Introduction of Genetic Vectors into the Host

In a preferred embodiment, endogenous cells are transfected with vectors such as those described herein in vivo by introduction of the therapeutic vector(s) into the host blood, tissues, nervous system, bone marrow, etc. The greatest benefit may be achieved by modifying a large number of endogenous target cells. This may be accomplished by using an appropriately-sized, catheter-like device, or needle to inject the therapeutic vector(s) into the venous or arterial circulation, into a specific tissue, such as muscle tissue, or into the nervous system. In a preferred embodiment, the virus is pseudotyped with VSV-G envelope glycoprotein and native HIV-1 env proteins.

Example 10: Injection into the Nervous System

Transplantation of selected cells (from either the growth or differentiation media) into the fetal nervous system or genetic modification of endogenous fetal cells utilizing genetic vectors may be accomplished in the following manner: Under sterile conditions, the uterus and fetuses are visualized by ultrasound or other radiological guidance. Alternatively the uterus may be exposed surgically in order to facilitate direct identification of fetal skull landmarks. Selected cells can then be introduced by injection (using an appropriately-sized catheter or needle) into the ventricular system, germinal zone(s), or into the substance of the nervous system. Injections may be performed in certain instances, through the mother's abdominal wall, the uterine wall and fetal membranes into the fetus. The accuracy of the injection is monitored by direct observation, ultrasound, contrast, or radiological isotope based methods, or by any other means of radiological guidance known to the art.

Under appropriate sterile conditions, direct identification of fetal skull landmarks is accomplished visually as well as by physical inspection and palpation coupled with stereotaxic and radiologic guidance. Following cell culture, appropriate amounts of the selected or differentiating cells can then be introduced by injection or other means into the ventricular system, germinal zones, or into the substance of the nervous system. The accuracy of the injection may be monitored by direct observation, ultrasound, or other radiological guidance.

In certain, neurological diseases of the adult nervous system, such as Huntington's disease and Parkinson's disease, cells of a specific portion of the brain are selectively affected. In the case of Parkinson's disease, it is the dopaminergic cells of the substantia nigra. In such regionally-specific diseases affecting adults, localized transplantation of cells may be accomplished by radiologically-guided transplantation of differentiating cells under sterile conditions. Radiologic guidance may include the use of CT and/or MIll, and may take advantage of contrast or isotope based techniques to monitor injected materials.

In certain neurologic diseases, such as some metabolic storage disorders, cells are affected across diverse regions of the nervous system, and the greatest benefit may be achieved by genetically-modifying endogenous cells or introducing selected cells of the present invention (either from the growth culture media or the differentiating medium) into the tissue in large numbers in a diffuse manner. In the nervous system, these diseases may be best approached by intraventricular injections (using an appropriately-sized, catheter-like device, or needle) (especially at early stages of development) which allows diffuse endogenous cell modification or diffuse engraftment of selected cells isolated from the growth and/or differentiation media. Nevertheless, injection of the cells into the circulatory system for the same purpose is also covered. However, with regard to any disorder affecting multiple organs or the body diffusely (e.g. lysosomal storage disorders, hemoglobinopathies, muscular dystrophy), the cells isolated from the growth and/or differentiation media may also be preferentially introduced directly into the circulation and/or visceral organs, such as the liver, kidney, gut, spleen, adrenal glands, pancreas, lungs, and thymus using endoscopic guidance and any appropriately-sized, catheter-like device, allowing diffuse engraftment of the cells throughout the body, as well as specific introduction and infiltration of the cells into the selected organs.

Example 11: Delivery of Cells by Injection into the Circulatory Stream and Organs Diseases of one organ system may be treatable with genetically modified cells from a separate organ system. Also, in some instances, it may become apparent that the selected cells may integrate and differentiate on their own, in vivo, in sufficient numbers if they are injected into blood stream either arterial, venous or hepatic, after culturing in the growth and/or differentiation media. This approach is covered by the present invention. The treatment of diffuse muscle (e.g. muscular dystrophies), organ, tissue, or blood disorders (e.g. Hereditary Spherocytosis, Sickle cell anemia, other hemoglobinopathies, etc.), may, for instance, involve the injection of cells isolated from the growth media or differentiating media into the patient, especially the patient's circulation. This approach is also believed to ameliorate ischemic injuries such as myocardial infarction, stroke, etc., as well as traumatic injuries to brain and other tissues. Injection of such cells produced by the current invention, directly into the circulation, by needle or catheter, so that the cells are enabled to "home" to the bone marrow, muscle, kidneys, lungs, and/or any other other organ system, as well as injection directly into the bone marrow space is suitable for the practice of the present invention. Likewise injection of the cells directly into a lesion site with or without radiologic, ultrasonic or fluoroscopic guidance is also suitable for the practice of the present invention.

Methods of isolating selected cells useful in the present invention include those described by Zhao et al., 2006.

In a preferred embodiment, genetic vectors encoding numblike and/or numb isoforms comprise regulable promoters operably linked to the Numb or numblike transgenes (or their corresponding proteins).

In another preferred embodiment, the mode of transfection may be selected from those modes of transfection that provide for transient rather than permanent expression of the numblike and numb isoforms.

Example 12: Example Genetic Modifications

Hundreds of diseases and clinical conditions are able to be treated and/or ameliorated by the methods of the present invention wherein a gene deficient in a patient is replaced or corrected by heterologous cells provided according to the present invention, or by autologous cells provided according to the present invention having the deficient gene replaced or repaired by genetic modification methods. Further, the transgenes, and vectors of the present invention may be delivered in vivo. Finally, proteins, including CRISPR/CAS9 related proteins, may be delivered by electroporation in vivo or in vitro, as taught herein. Examples of diseases amenable to such correction, replacement or repair include, but in no way are limited to, Canavan's disease (ASP); Tay-Sachs disease (HEXA); Lesch-Nyhan syndrome (HRPT); Huntington's disease (HTT); Sly syndrome; type A and type B Niemann Pick disease; Sandhoff s disease (HEXB); Fabry's disease (GLA); type C Niemann-Pick disease (NPC1); Gaucher's disease (GBA); Parkinson's disease (PARK2, etc.); Von Hippel Lindau's disease, Sickle cell anemia (HBB) and other thalassemias as well as similar diseases. These transgenes may represent the coding region or portions of the coding region of the normal genes.

It is to be understood, however, that the scope of the present invention is not to be limited to the specific embodiments and examples described above. The invention may be practiced other than as particularly described and still be within the scope of the accompanying claims.

Example 13

An example sequence for a vector capable of rendering cells pluripotent and expressing a long Numb isoform, Oct-4, Sox-2, and EmGFP nucleic acid sequences under the control of tetracycline-sensitive promoters corresponds to (SEQ ID NO: 2).

A schematized map corresponding to the vector sequence above is shown in FIG. 3C.

The vector may be constructed fully through de novo gene synthesis, or in part through the cloning of the Numb, Sox and OCT3/4 cDNA sequences into the position occupied by LacZ in the Invitrogen pcDNA4tolacZ vector. Similarly, the tetR gene is found in the Invitrogen pcDNA6/TR vector. Coding sequences of genes referenced are also appropriate for cloning into the pcDNA4lacZ vector.

Alternatively, the tetR gene may be transfected into target cells separately utilizing the pcDNA6/TR vector in combination with a vector comprising the sequence here minus the tetR gene and its PCMV promoter.

Likewise, multiple vectors may be employed so long as elements similar to the elements included in the above sequence are present. This may reduce the likelihood of promoter competition. It is to be understood that other conditional promoter elements may be substituted for the tetracycline sensitive promoter elements.

Also depicted in FIG. 3A and FIG. 3B, are other lentiviral vectors expressing Oct4 and Sox2 or PRR+ Numb. Integrase-deficient $2^{nd}$ and $3^{rd}$ generation lentiviral vectors may be utilized as non-integrating lentiviral vectors can be used as episomal vectors, in like manner to adenoviral (Lin et al., 2007), AAV, hybrid vectors, plasmid DNA, and other non-integrating vectors known to the art. Such integrase-deficient vectors can be readily introduced using a variety of standard transfection techniques (e.g. electroporation, chemically mediated transfection, fusogenic or non-fusogenic liposomes, lipofectamine, nanocapsules, nanovaults, etc.)—methods which allow high capacity integrase-deficient lentiviral vectors to be utilized without genomic integration and random alteration of the genome.

Example 14

It is expected that intravenous and other administration of pluripotent stem cells produced according to the methods described herein (or other published methods) one or more times can provide replacement cells to the body and that such administration may serve to extend the life or improve the health of the patient suffering age-related senescence.

Example 15. Production of Germ Cells

The current invention covers the derivation of germ cells from dividing multipotent, pluripotent, "VSEL-like" and/or "pluripotent-like" stem cells produced according to the methods described herein (or according to other published methods). The production of such germ cells may be suitable for treating infertility and producing embryos in vitro (e.g. Hubner et al., 2003; Kehler et al., 2005; Nayernia et al., 2006a; Nayernia et al., 2006b; Drusenheimer et al., 2007; Moore et al., 2007; etc.).

Likewise, the invention further covers transient or permanent transfection/contacting with other proteins and/or nucleic acid sequences, including ones selected from those encoding FIGLA, FIG alpha, DAZL, STRA8, FOXL2, OOGENESIN1, OOGENESIN2, OOGENESIN3, OOGENESIN4, SYCP2, SYCP3, SPO11, REC8, DMC1, MOS, STAG3, CCNB1, FOXO1, FOXO3, SOHLH1, SOHLH2, NOBOX, OBOX1, OBOX2, OBOX3, OBOX4, OBOX6, LHX8, LHX9, OOG1, SP1, ZFP38, TRF2, TB2/TRF3, TAF4B, TAF7L, TAF71, TIA1, PHTF1, TNP2, HILS1, DAZL, BMP15, PTTG3, AURKC, OTX2, SOX15, SOX30, FOXR1, ALF, OCT4, DPPA3/STELLA, ZFP38, RPS6KA3, HINFP, NPAT, SP1, SP3, HOXA1, HOXA7, HEX, YP30, ZP1, ZP2, ZP3, SFE1, SFE9, OPO, PLN, RDV, GLD1, MMU-MiR351, MMU-MiR615, MMU-MiR592, MMU-MiR882, MMU-MiR185, MMU-MiR491, MMU-MiR326, MMU-MiR330, MMU-MiR351.

Likewise, the invention further covers transfection/contacting with other proteins and/or nucleic acid sequences, including ones selected from those encoding SYCP2, SYCP3, SPO11, REC8, DMC1, MOS, STAG3, OCT4, ALF, RPS6KA3, HINFP, SP1, SP3, TAF71, TIA1, PHTF1, TNP2, HILS1, CLGN, TEKT1, FSCN3, DNAHC8, LDHC, ADAM3, OAZ3, AKAP3, MMU-MiR351, MMU-MiR615, MMU-MiR592, MMU-MiR882, and MMU-MiR185.

Likewise, the invention further covers transfection/contacting with other proteins and/or nucleic acid sequences, including ones selected from those encoding MOS, CCNB1, OCT4, FIG alpha, FIGL alpha, ALF, SOHLH1, SOHLH2, LHX8, LHX9, OOG1, FIG alpha, SP1, LHX3, LHX9, TBP2/TRF3, DAZL, BMP15, GDF9, PTTG3, AURKC, OTX2, SOX15, SOX30, FOXR1, NOBOX, OBOX1, OBOX2, OBOX3, OBOX6, OOGENESIN1, OOGENESIN2, OOGENESIN3, OOGENESIN4, YP30, ZP1, ZP2, ZP3, SFE1, SFE9, OPO, PLN RDV, GLD1, DAZL, STRA8, MMU-MiR615, MMU-MiR491, MMU-MiR326, MMU-MiR330, MiR212 and MMU-MiR351.

Example 16: Generation of Transgenic Animals

The present invention covers the generation of transgenic animals. As with other pluripotent cells, the pluripotent or pluripotent-like cells produced according to the methods described herein (or other published methods) may be utilized to produce transgenic animals by any method known to the art.

Example 17: Therapeutic Vector Construction

Examples of retroviral vectors which may be employed include, but are not limited to, those derived from Moloney Murine Leukemia Virus, Moloney Murine Sarcoma Virus, and Rous Sarcoma Virus, FIV, and HIV. Appropriate expression vectors are that may be employed for transfecting DNA or RNA into eukaryotic cells. Such vectors include, but are not limited to, prokaryotic vectors such as, for example, bacterial vectors; eukaryotic vectors, such as, for example, yeast vectors and fungal vectors; and viral vectors, such as, but not limited to, lentiviral vectors, adenoviral (Lin et al., 2007) vectors, adeno-associated viral vectors, and retroviral vectors.

The replication incompetent pcDNA 6.2 GW/miR and pcDNA 6.2/EmGFP-Bsd/V5-DEST vectors are examples of an appropriate expression vectors (Invitrogen) and allow expression of synthetic oligonucleotides (e.g. miRNAs) that have the capacity to cleave targeted sequences (or their corresponding proteins). These vectors include flanking and loop sequences from endogenous miRNA to direct the excision of the engineered miRNA from a longer Pol II transcript (pre-miRNA).

Alternatively, inclusion of the HIV psi sequence allows the therapeutic vector to compete with native HIV genome for packaging into viral particles, also inhibiting HIV transmission.

Combining multiple miRNA sequences directed against a single target increases the likelihood of success in reducing target sequence expression. miRNA sequences may be operably linked to tissue specific promoters such as the EF-1 alpha promoter, any T cell specific promoter, or macrophage specific promoter to ensure expression in the desired cell types.

Utilizing Invitrogen's lentiviral destination (DEST) vectors for gene expression, the resulting therapeutic vector(s) becomes capable of stably transducing both dividing and non-dividing cell types.

In a preferred embodiment, the therapeutic vector(s) contains multiple synthetic oligonucleotide sequences driven by one or more promoters so as to reduce expression of CXCR4, CCR5, and/or any other cellular protein known to act as a co-receptor for HIV infection in target cells.

In one therapeutic vector (constructed in 2006), four miRNA sequences targeting CXCR4 and CCR5 co-receptors were cloned into the pcDNA 6.2 GW/miR vector along with decoy RNA sequences targeting HIV-2 TAR and RRE.

Genetic constructs may include a vector backbone, and a transactivator which regulates a promoter operably linked to heterologous nucleic acid sequences (or their corresponding proteins).

Another example of a suitable vector is a retroviral vector. Retroviruses are RNA viruses which contain an RNA genome. The gag, pol, and env genes are flanked by long terminal repeat (LTR) sequences (or their corresponding proteins). The 5' and 3' LTR sequences promote transcription and polyadenylation of mRNAs.

The retroviral vector may provide a regulable transactivating element, an internal ribosome reentry site (IRES), a selection marker, and a target heterologous gene operated by a regulable promoter.

Alternatively, multiple sequences may be expressed under the control of multiple promoters. Finally, the retroviral vector may contain cis-acting sequences necessary for reverse transcription and integration. Upon infection, the RNA is reverse transcribed to DNA which integrates efficiently into the host genome. The recombinant retrovirus of this invention is genetically modified in such a way that some of the retroviral, infectious genes of the native virus are removed and in embodiments replaced instead with a target nucleic acid sequence for genetic modification of the cell. The sequences may be exogenous DNA or RNA, in its natural or altered form.

Example 18: Example Methods for Generation of the Therapeutic Vector

The methods for generation of the therapeutic vector(s) include those taught in Invitrogen's Viral Power Lentiviral Expression Systems Manual (incorporated by reference herein). Briefly, the EmGFP-bsd cassette is cloned as a Pm1I-BlpI fragment into the pLenti6/R4R2/V5-DEST vector, while the miR-decoy cassette is simultaneously transferred by BP reaction into pDONR221. Then the EF1a promoter and miR-decoy are Muti-site LR crossed into the modified pLenti6/EmGFP-b sd/R4R2-DESTvector.

pLenti6/R4R2/V5-DEST vector sequence (SEQ ID NO: 1), Example miR-decoy cassette sequence (SEQ ID NO: 3).

Example 19: Methods for Propagating/Proliferating Stem/Progenitor Cells In Vivo

In order to obtain large numbers of target cells that are relatively resistant to 1) HIV infection and/or 2) HIV replication and/or 3) HIV transcription, progenitor/stem cells can be grown in Dulbecco's modified Minimal Essential Medium (DMEM) supplemented with glutamine, beta.-mercaptoethanol, 10% (by volume) horse serum, and human recombinant Leukemia Inhibitory Factor (LIF). The LIF replaces the need for maintaining progenitor/stem cells on feeder layers of cells, (which may also be employed) and is essential for maintaining progenitor/stem cells in an undifferentiated state.

Example 20

Cells are collected from individuals, developmentally-activated, transfected with the therapeutic vectors, then cultured and prepared for autologous or heterologous transplantation by standard methods, with or without HLA typing and matching.

Example 21

Umbilical cord blood samples are obtained from umbilical blood cord bank. The cells are then (with or without developmental activation) transfected with the therapeutic vector of beneficial sequences (or their corresponding proteins), then prepared for transplantation by standard methods, with or without HLA typing and matching.

Example 22: Examples of Synthetic Oligonucleotide Sequences Suitable for Inclusion in the Therapeutic Vector Any synthetic oligonucleotide sequences that successfully reduce the protein expression of targeted sequences >70% is covered by the present invention. See FIG. 17D.

Any synthetic oligonucleotide sequences that successfully reduce the ability of target cells to sustain HIV replication by >70% or to a lesser but therapeutic degree or HIV viral activity by >70% or to a lesser but therapeutic degree are also covered by this invention.

Examples of miRNA sequences include miRNA sequences derived by IVGN algorithm(Invitrogen). miRNA sequences targeting the CXCR4 gene include top strand: 5'-TGCTGATACCAGGCAGGA-TAAGGCCAGTTTTGGCCACTGACTGACTGGCCT-TACTGCCTGGTAT-3' (SEQ ID NO: 4) and bottom strand: 5'-CCTGA-TACCAGGCAGTAAGGCCAGTCAGTCAGTGGC-CAAAACTGGCCTTATCCTGCCTGGTATC-3' (SEQ ID NO: 5); as well as top strand: 5'-TGCTGTGACCAG-GATGACCAATCCATGTTTTGGCCACTGACTGA-CATGGATTGCATCCTGGTCA-3' (SEQ ID NO: 6) and bottom strand: 5'-CCTGTGACCAGGATGCAATC-CATGTCAGTCAGTGGCCAAAACATGGATTGGT-CATCCTGGTCAC-3' (SEQ ID NO: 7).

Similarly, miRNA sequences targeting the CCR5 gene include top strand: 5'-TGCTGATCGGGTGTAAACT-GAGCTTGGTTTTGGCCACTGACTGACCAAGCTCAT-TACACCCGAT-3' (SEQ ID NO: 8) and bottom strand: 5'-CCTGATCGGGTGTAAT-GAGCTTGGTCAGTCAGTGGCCAAAAC-CAAGCTCAGTTTACACCCGATC-3' (SEQ ID NO: 9); as well as top strand 5'-TGCTGATAGCTTGGTC-CAACCTGTTAGTTTTGGC-CACTGACTGACTAACAGGTGACCAAGCTAT-3' (SEQ ID NO: 10) and bottom strand: 5'-CCTGATAGCTTGGT-CACCTGTTAGTCAGTCAGTGGC-CAAAACTAACAGGTTGGACCAAGCTATC-3' (SEQ ID NO: 11).

Example 23

Examples of Decoy RNA suitable for inclusion in the therapeutic vector. Any decoy sequences that successfully reduce the ability of target cells to sustain HIV replication by >70% or to a lesser but therapeutic degree or HIV viral activity by >70% or to a lesser but therapeutic degree are covered by this invention.

An example TAR decoy sequence is (SEQ ID NO: 12)

Figure 17D:
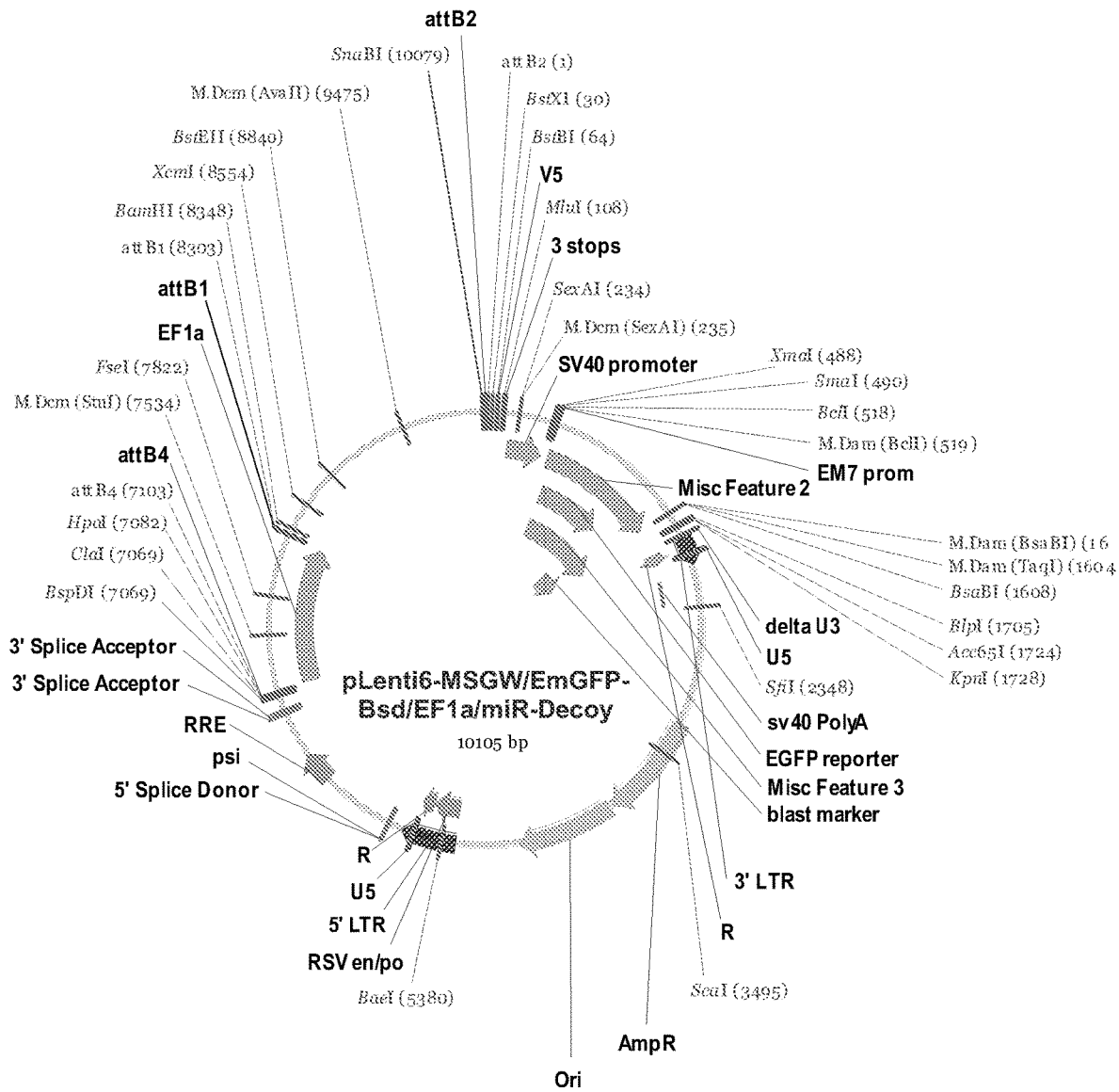
FIG. 17D is a pLenti6-MSGW/EmGFP-Bsd/EF1a/miR-decoy vector map.

```
gtcgctgcggagaggctggcagattgagccctgggaggttctctccagca ctagcaggtagagcctgggtgttccctgctagactctcaccagtgcttgg ccggcactgggcagacggctccacgcttgcttgcttaaagacctcttaat aaagctgc.
```
(Browning et al., 1999)
See FIG. 17D.

An example RRE decoy sequence is (SEQ ID NO: 13)

```
tgctagggttcttgggttttctcgcaacagcaggttctgcaatgggcgcg gcgtccctgaccgtgtcggctcagtccoggactttactggccgggatagt gcagcaacagcaacagagttggacgtggtcaagagacaacaagaactgtt
```

```
gcgactgaccgtaggggaacgaaaaacctccaggcaagagtcactgctat agagaagtacctacaggaccaggcgcggctaaattcatggggatg.
```
(Dillon et al., 1990)
See FIG. 17D.

Example 24: Flanking Sequences Providing Stability for RNA Decoys

Examples of appropriate flanking sequences for RNA decoys are as follows:

TAR DECOY SEQ
                                         (SEQ ID NO: 14)
GUGCUCGCUUCGGCAGCACGTCGAC (SEQ ID NO: 15)
UCUAGAGCGGACUUCGGUCCGCUUUU

RRE DECOY SEQ
                                         (SEQ ID NO: 16)
GUGCUCGCUUCGGCAGCACGTCGAC (SEQ ID NO: 17)
UCUAGAGCGGACUUCGGUCCGCUUUU.
See FIG. 17D.

Previously, it was demonstrated that decoy sequences flanked by hairpins on either side, 19 nucleotides (ntds) of the U6 RNA on the 5' side as well as a 3' stem immediately preceding a poly U terminator for POLIII, showed greater stability. This arrangement is expected to protect against 3'-5' exonuclease attack, and to reduce the chances of the 3' trailer interfering with the insert RNA folding. Since only the first ¾ of the tRNA sequence is present, the 5' end of the insert should be protected and export from the nucleus should be prevented (Good et al., 1997).

Example 25: Introduction of Therapeutic Vector to the Host

In a preferred embodiment, blood stem/progenitor cells, and target cells are transfected with the therapeutic vector(s) (or associated therapeutic virus) in vivo by introduction of the therapeutic vector(s) into the host blood, tissues, or bone marrow, etc. The greatest benefit may be achieved by modifying a large number of endogenous target and stem/progenitor cells. This may be accomplished by using an appropriately-sized, catheter-like device, or needle to inject the therapeutic vector(s) into the venous or arterial circulation. In a preferred embodiment, the virus is pseudotyped with VSV-G envelope glycoprotein and native HIV-1 env proteins.

Example 26: Introduction of Genetically-Modified Cells into the Host

Blood cells, such as mature peripheral blood T lymphocytes, monocytes, macrophages, T cell progenitors, macrophage-monocyte progenitor cells, and/or pluripotent hematopoietic stem cells (such as those found in umbilical cord blood and occupying bone marrow spaces) as well as other stem/progenitor cells can be transfected using the therapeutic vector(s) in vitro. Appropriate concentrations of the therapeutic vector(s) may be those consistent with Browning et al., 1999. Subsequently, cells are expanded (propagated) in vitro, and are then transferred to the host via introduction of the cells to the venous or arterial circulation using an intravenous needle or catheter. Subsequently, cells transfected with the therapeutic vectors are able to "home" to the bone marrow and other tissues.

It is understood that the examples and embodiments described herein are for illustrative purposes only and that various modifications or changes in light thereof will be suggested to persons skilled in the art and are to be included within the spirit and purview of this application and scope of the appended claims. All publications, patents, and patent applications cited herein are hereby incorporated by reference in their entirety for all purposes.

Example 27

Fluorescein-conjugated albumin protein is delivered in high concentration to the interior of 3T3 cells with high efficiency using protein electroporation, according to the method of Koken et al., 1994.

Protein Electroporation

3T3 cells electroporated at 300V with a varying number of 5 ms pulses showed progressively increased protein uptake (see FIGS. 4A-4D). ~200,000 3T3 cells were electroporated in a 4 mm cuvette in the presence of FITC-conjugated albumin (150 ug/200 ul). Visual inspection and photography using a fluorescent microscope revealed progressively increased FITC-albumin uptake and fluorescence over a wide range of pulse number (10-200 pulses). FIGS. 4A-4D depict the cells (at low power magnification, 10×) 48 hours after exposure to 20 pulse (FIG. 4A), 50 pulse (FIG. 4B), 100 pulse (FIG. 4C) and 200 pulse (FIG. 4D) electroporation, demonstrating protein uptake was a function of electroporation.

Example 28

Long PRR+Numb alone, or in combination with Oct4, Sox2, Nanog and/or Notch proteins, activated/reprogrammed the cells such that they were shown to be newly-positive for SSEA3, SSEA4, and Tra-1-81 antigens, indicative of pluripotent stem cells, as well as endogenous Oct4, Sox2, Nanog and PRR+ Numb proteins.

Cell Culture

Prior to electroporation, 3T3 cells and 3T3-PRR+ Numb cells were maintained in growth medium (GM) containing DMEM supplemented with 10% fetal bovine serum (FBS), 20 mM L-glutamine, and 1% penicillin/streptomycin.

Protein Electroporation

3T3 cells and 3T3-PRR+ Numb cells were harvested and electroporated using the BTX ECM 830 electroporation machine according to the methods of Koken et al., 1994. Briefly, ~200,000 cells were transferred to 4 mm cuvettes and electroporated in the presence of either 50 ug Notch protein or 150 ug of oct4/sox2/nanog protein cocktail. Immediately following electroporation, the cells were transferred to Dulbecco's Modified Eagle Medium (DMEM) in standard cell culture plates with or without 20 ng/ml EGF, and incubated at 37 degrees Celsius.

Immunohistochemistry

In all of these experimental conditions, long PRR+ Numb alone or in combination with Oct4, Sox2, Nanog and/or Notch proteins activated/reprogrammed the cells such that they were shown to be newly-positive for SSEA3, SSEA4, and Tra-1-81 antigens, indicative of pluripotent stem cells, as well as endogenous Oct4, Sox2, Nanog and PRR+ Numb proteins. See FIGS. 5A-5D and 6A-6D.

Example 29

Non-pluripotent Murine Cells electroporated with Oct4, Sox2, Nanog and Notch-1 proteins (300V, 70 pulses, 50 ug per protein), or overexpressing the long PRR+Numb isoform, cluster hierarchically and in Principal Component Analysis (PCA) plots amongst published, pluripotent ES and iPS cells.

Cell Culture

Prior to electroporation, 3T3 cells and 3T3-PRR+Numb cells were maintained in growth medium (GM) containing DMEM supplemented with 10% fetal bovine serum (FBS), 20 mM L-glutamine, and 1% penicillin/streptomycin.

Protein Electroporation

3T3 cells and 3T3-PRR+ Numb cells were harvested and electroporated using the BTX ECM 830 electroporation apparatus according to the methods of Koken et al., 1994. Briefly, 200,000 -1M cells were transferred to 4 mm cuvettes and electroporated in the presence of 200 ug/ml oct4/sox2/nanog/notch protein cocktail. Immediately following electroporation, the cells were a) returned to growth medium at 37 degrees.

Figure 7A:
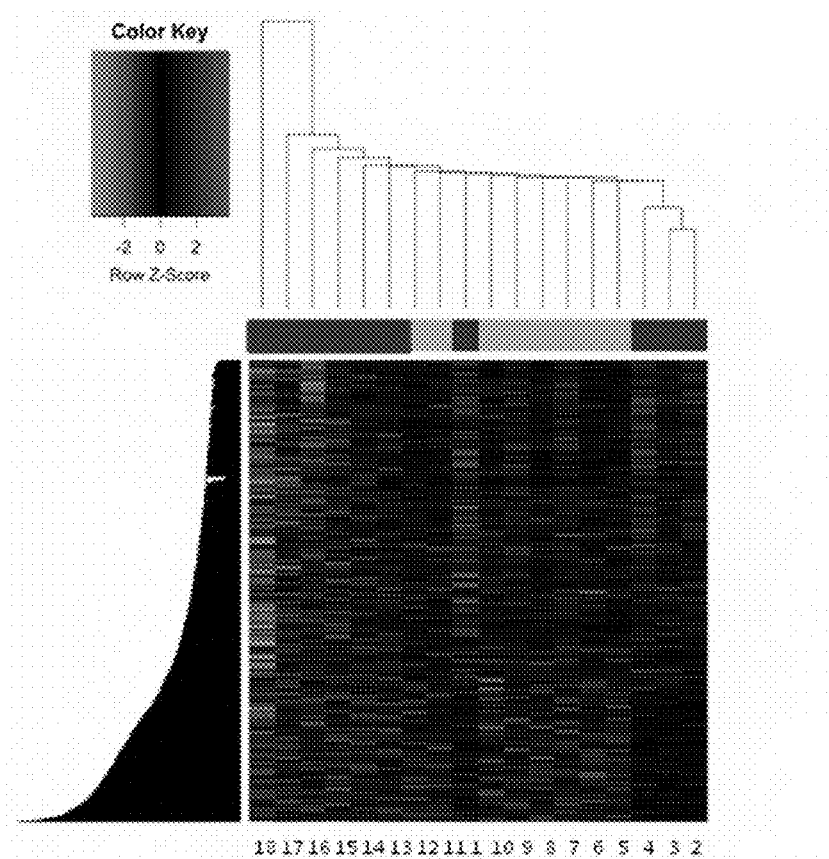
FIGS. 7A and 7B illustrate Murine Cells electroporated with Oct4, Sox2, Nanog and Notch-1 proteins (300V, 70 pulses, 50 ug per protein), or overexpressing the long PRR+Numb isoform, clustered hierarchically in Heatmaps and in Principal Component Analysis (PCA) plots amongst other published, pluripotent ES and iPS cells analyzed using the Affymetrix GeneChip HTA 2.0 chip (GSE53299 and GSE61403).
Figure 7B:
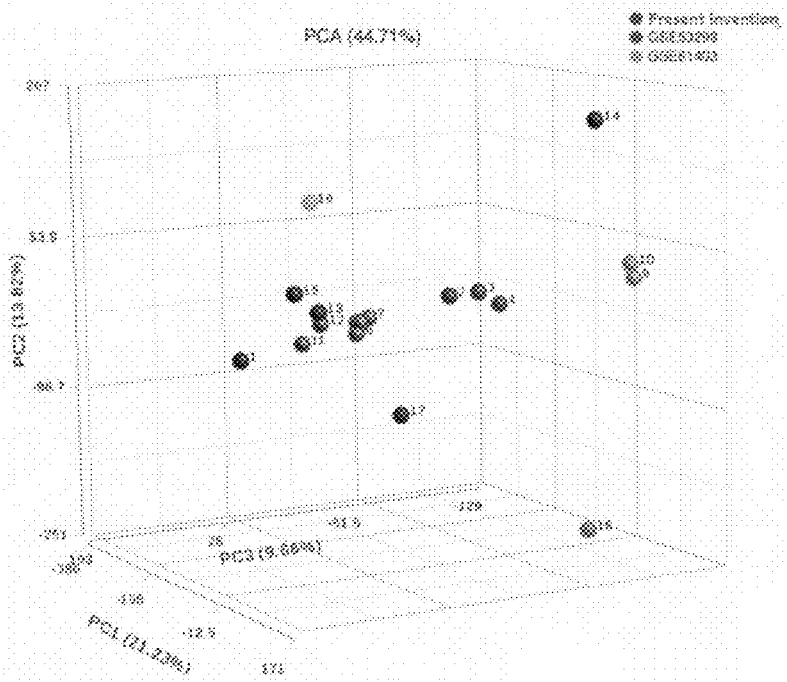

Resulting embryoid bodies, floating colonies and cells adherent 4 days post-electroporation were collected and their RNA extracted for gene array analysis using the Affymetrix GeneChip HTA 2.0 chip. Murine Cells electroporated with Oct4, Sox2, Nanog and Notch-1 proteins (300V, 70 pulses, 50 ug per protein), or overexpressing the long PRR+Numb isoform, clustered hierarchically in Heat-maps (FIG. 7A) and in Principal Component Analysis (PCA) plots (FIG. 7B) amongst published, pluripotent ES and iPS cells (GSE53299 and GSE61403).

Reactome analysis reactome.org was further performed based on the results of the gene array analysis and revealed that treated cells showed enriched or overexpressed genes in, for example the Cell Cycle pathways and Developmental pathways (including the Transcriptional regulation of pluripotent stem cells sub-pathway).

Example 30

Figure 8A:
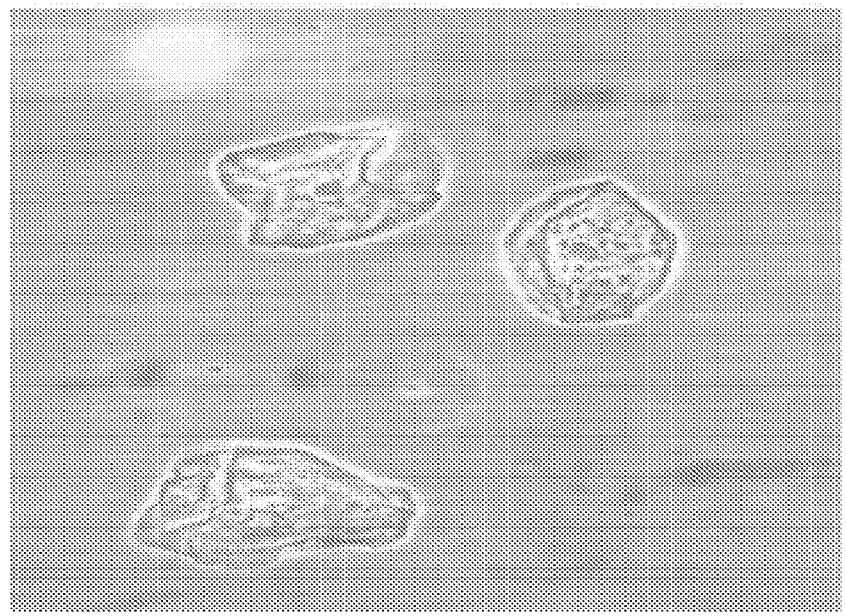
FIGS. 8A and 8B illustrate human buccal cheek cells imaged with brightfield (FIG. 8A) and fluorescent (FIG. 8B) microscopy 48 hours after electroporation (per Koken et al., 1994; 300V, 70 pulses, 5 ms pulses, 100 ms pulse-interval) in the presence of FITC-conjugated albumin.
Figure 8B:
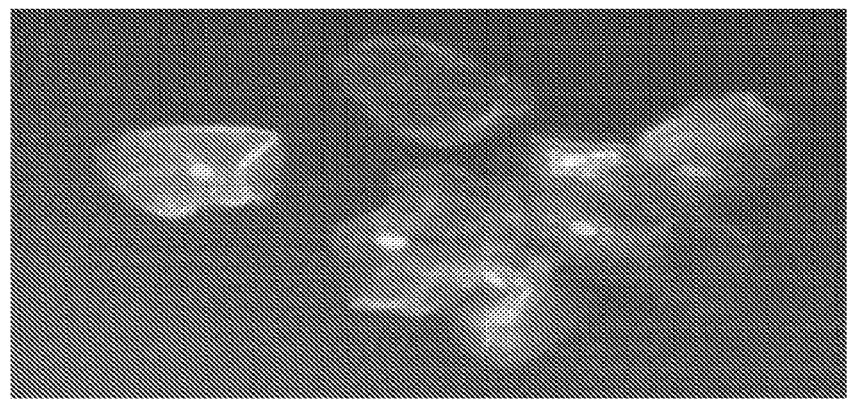
Figure 9A:
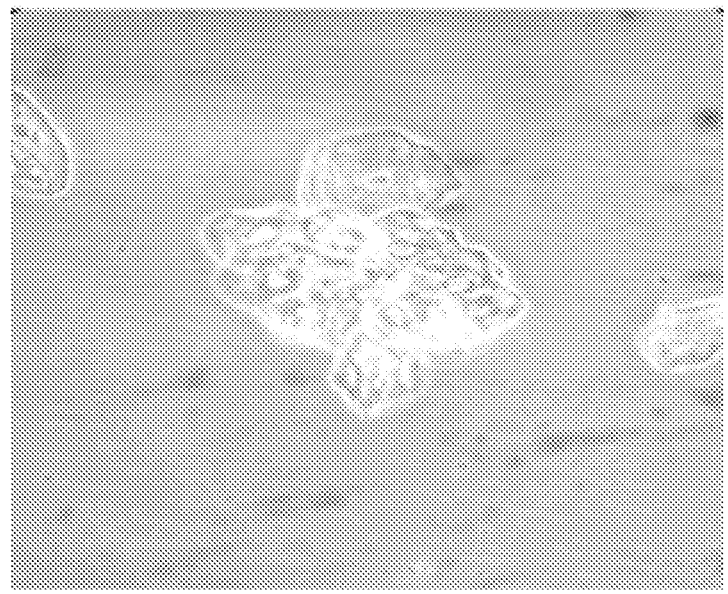
FIGS. 9A-9C illustrate cell colonies induced from buccal cheek cells at 6 days (FIG. 9A and FIG. B) and 46 days (FIG. 9C) after electroporation per Koken et al., (1994).
Figure 9B:
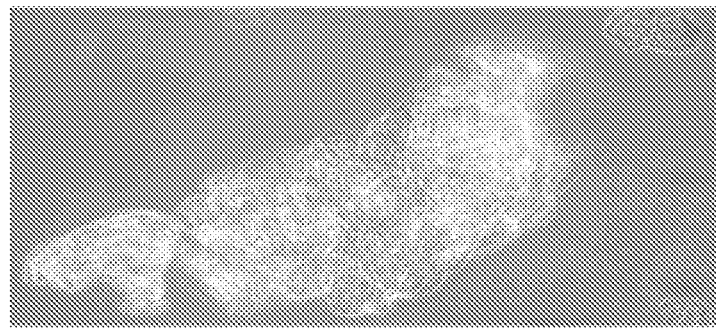
Figure 9C:
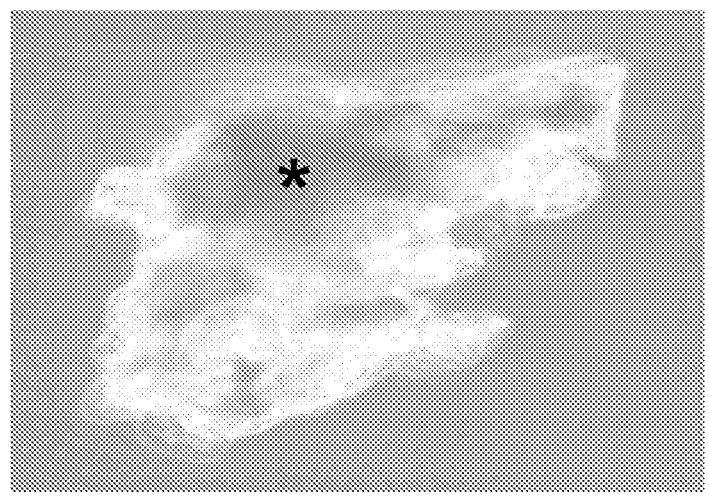
Figure 10A:
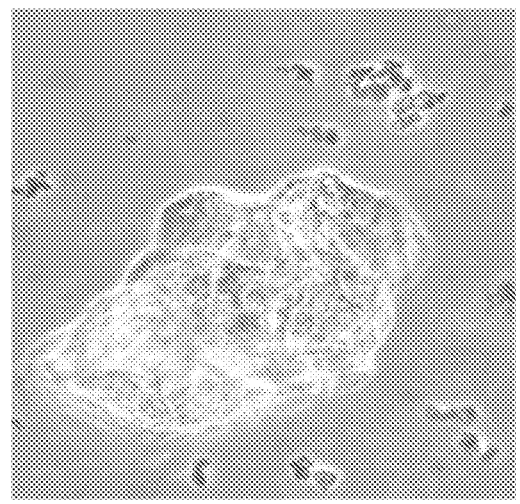
FIGS. 10A-10C illustrate that 7 weeks after electroporation, cell colonies induced from buccal cheek cells using electroporation express pluripotency associated proteins Oct 4 (FIG. 10A), Nanog (FIG. 10B), and Sox2 (FIG. 10C).
Figure 10B:
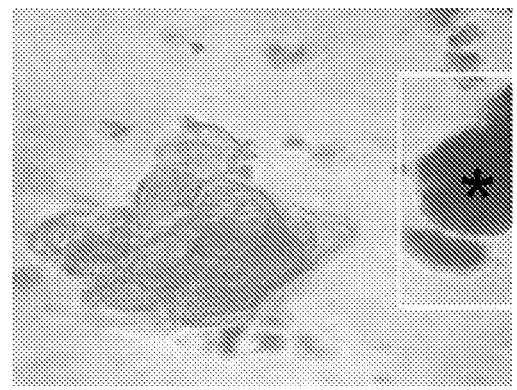
Figure 10C:
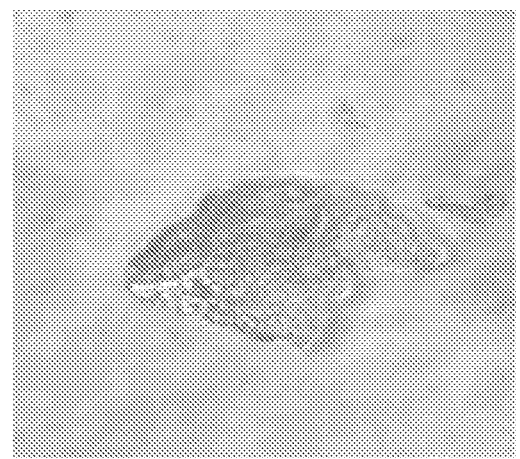
Figure 11A:
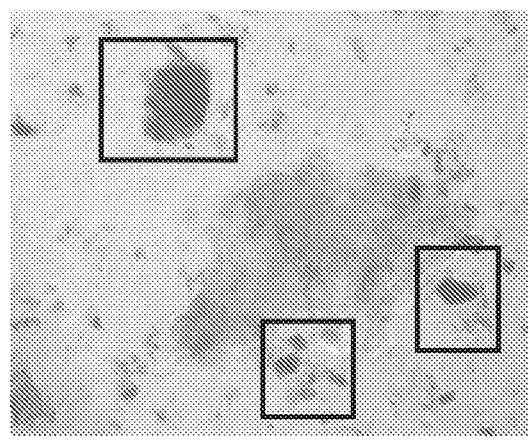
FIGS. 11A-11I illustrate that protein electroporation with Oct4, Sox2 and Nanog produces developmentally-activated, buccal cheek cells that form colonies and embryoid (rectangles) reactive for Nanog (FIGS. 11A-11C), Sox2 (FIGS. 11D-11F) and Oct4 (FIGS. 11G-11I).
Figure 11B:
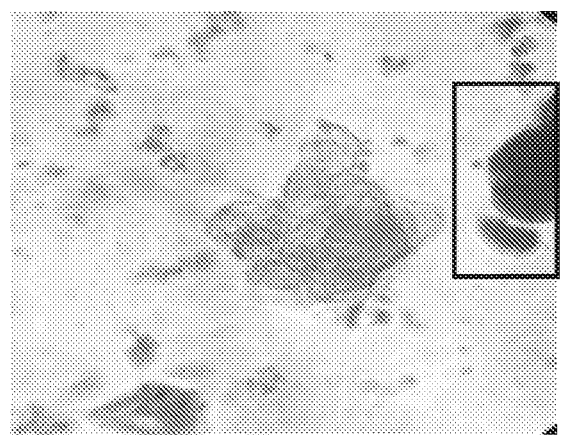
Figure 11C:
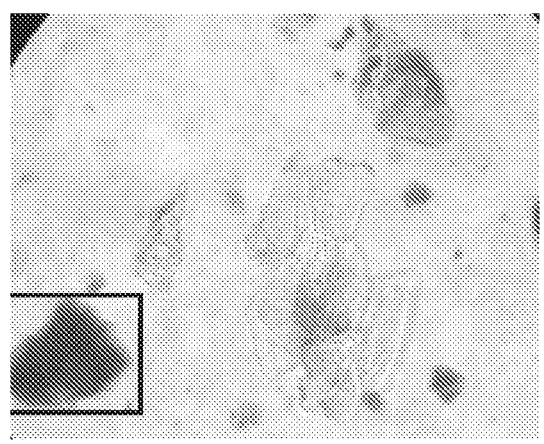
Figure 11D:
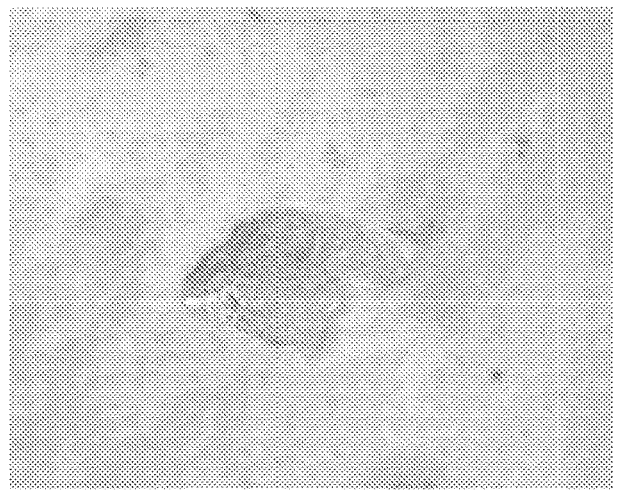
Figure 11E:
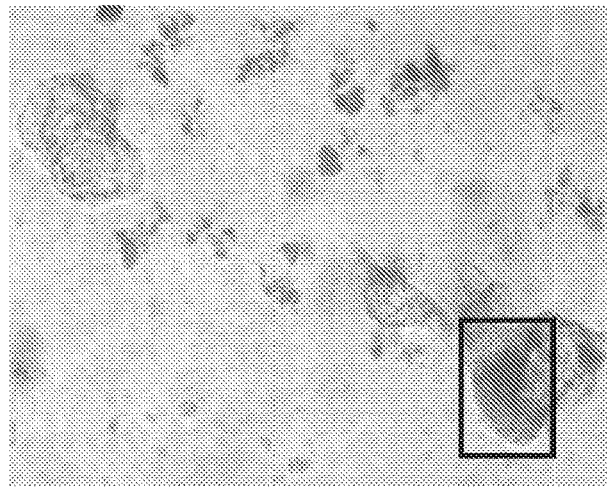
Figure 11F:
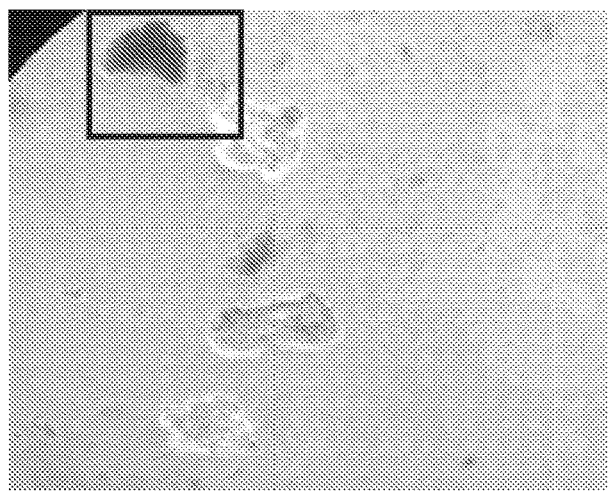
Figure 11G:
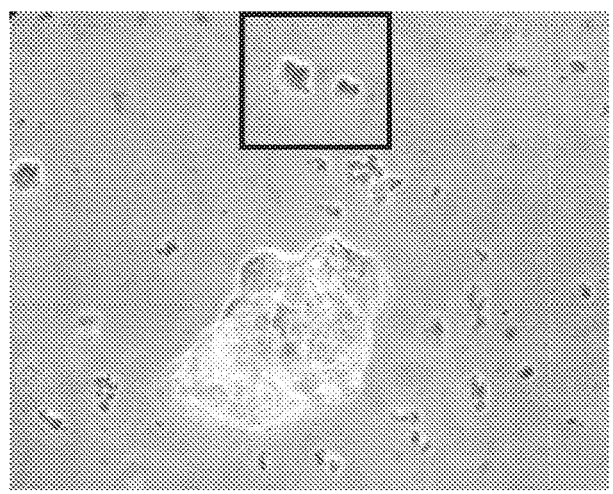
Figure 11H:
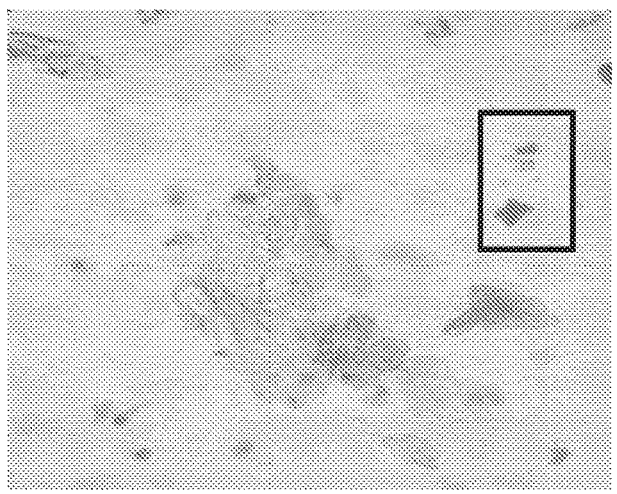
Figure 11I:
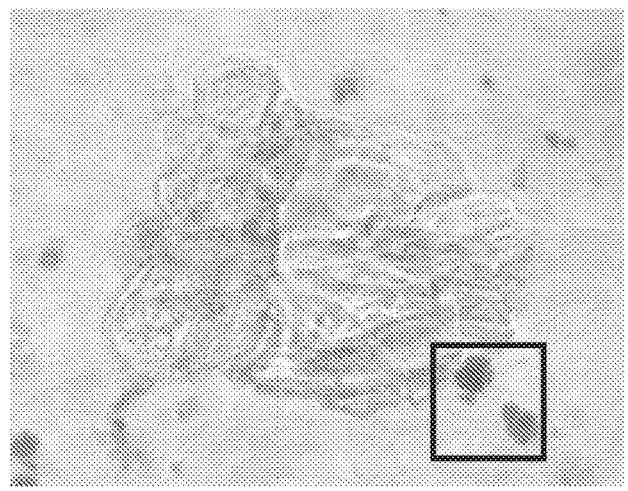

After electroporation with Oct4, Sox2, and Nanog proteins, human buccal cheek cells are induced to pluripotent-like, Developmentally-Activated Cells: They Divide, Form Colonies, Form Embryoid composed of VSEL cells, and Express Oct4, Sox2, and Nanog Proteins. 200,000 human buccal cheek cells were electroporated in a 4 mm cuvette with 300V in the presence of FITC-conjugated albumin (150 ug/200 ul). Approximately 200,000 human buccal cheek cells were electroporated in a 4 mm cuvette in the presence of FITC-conjugated albumin (150 ug/200 ul). Increasing number of pulses led to progressively increased FITC-albumin uptake and fluorescence. See FIGS. 8A, 8B. Increasing number of pulses led to progressively increased FITC-albumin uptake and fluorescence. Photomicrographs show a small colony (FIG. 9A) and a much larger colony of proliferating epithelioid cells (FIG. 9B) induced 6 days after electroporation in the presence of 150 ug Oct4, Sox2 and Nanog protein. By 46 days post-electroporation with Oct4, Sox2, and Nanog proteins, colonies visible at low power (10×) mostly comprised darker appearing embryoid (asterisk) composed of VSEL-like cells (FIG. 9C). Immunohistochemistry showed electroporated cheek cells expressed Oct4 (FIG. 10A), Nanog (FIG. 10B), and Sox2 (FIG. 10C). Dense, darkly stained embryoid was composed of VSEL-like cells (*) are apparent on FIG. 10B.

Example 31

Figure 12A:
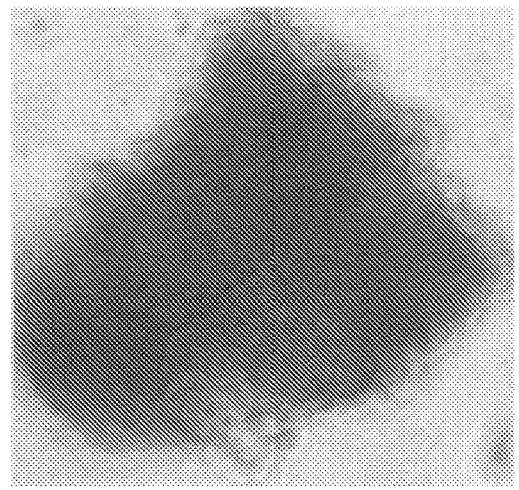
FIGS. 12A-12C illustrate that protein electroporation with Oct4, Sox2 and Nanog produces developmentally-activated, buccal cheek that form embryoid composed of VSEL-like cells with positive reactivity for Nanog (FIG. 12A), Sox2 (FIG. 12B) and Oct4 (FIG. 12C).
Figure 12B:
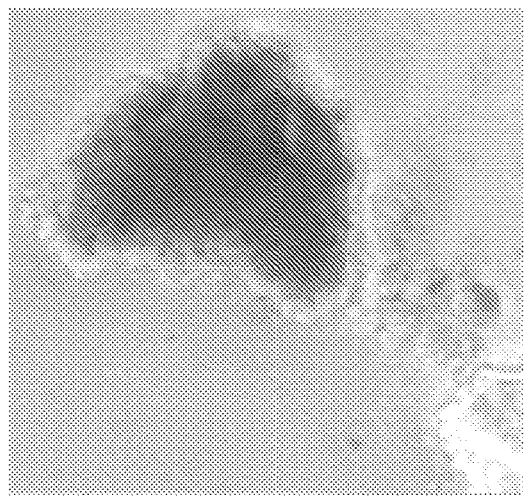
Figure 12C:
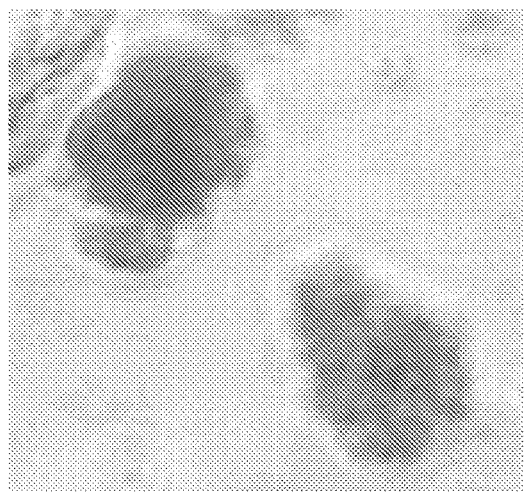

Protein Electroporation "flips the Switch". After electroporation in PBS with 50 ug, each, of Oct4, Sox2, and Nanog proteins, human buccal cheek cells are induced to pluripotent-like, Developmentally-Activated Cells (DAdC). 14 days post-electroporation, erstwhile epithelial, buccal cheek cells show altered morphologies, divide, form colonies, form embryoid composed of VSEL cells, and express Oct4, Sox2, and Nanog Proteins. (FIGS. 11A-11I). Embryoid positively-stained after immunohistochemistry using antibodies against Nanog, Sox2 and Oct4, well-known markers of pluripotency. The embryoid was formed by buccal cheek cells following electroporation with Oct4 (FIG. 12C), Sox2 (FIG. 12B) and Nanog (FIG. 12A) proteins in PBS (300V, 70 pulses), and consists of VSEL-like cells (Ratajczak, et al., 2008; Kuruca, et al., 2019).

Example 32

Figure 13A:
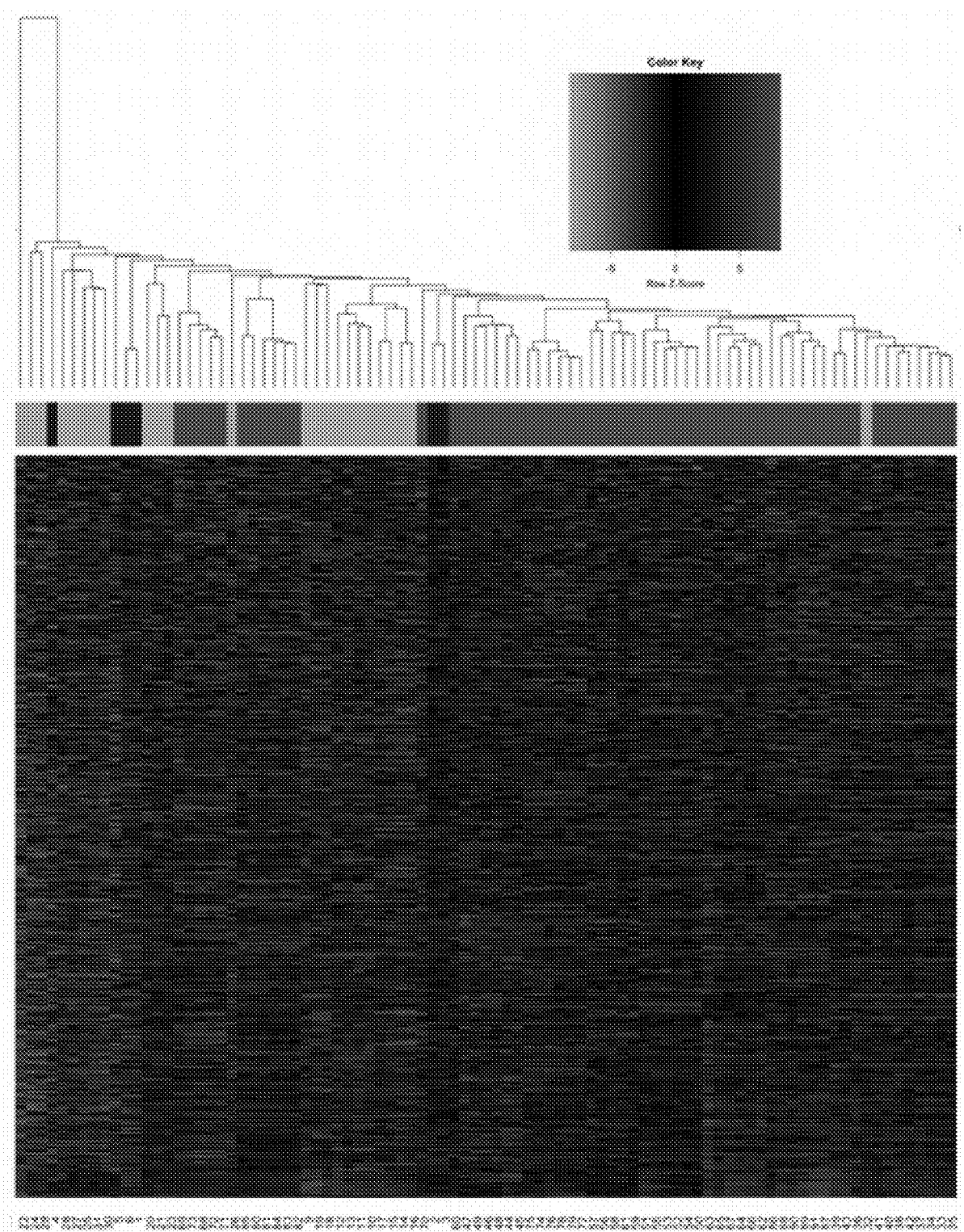
FIGS. 13A-13B illustrate that human hepatocyte cells transfected and activated-developmentally with lentivirally-encoded i) PRR+Numb, ii) Oct4/Sox2, or iii) PRR+Numb, Oct4, and Sox2, cluster hierarchically in Heatmaps and in corresponding Principal Component Analysis (PCA) plots amongst other published, pluripotent ES and iPS cells analyzed using the GeneChip Affymetrix Human Genome U133 2.0 Array (GSE76830 and GSE88963).
Figure 13B:
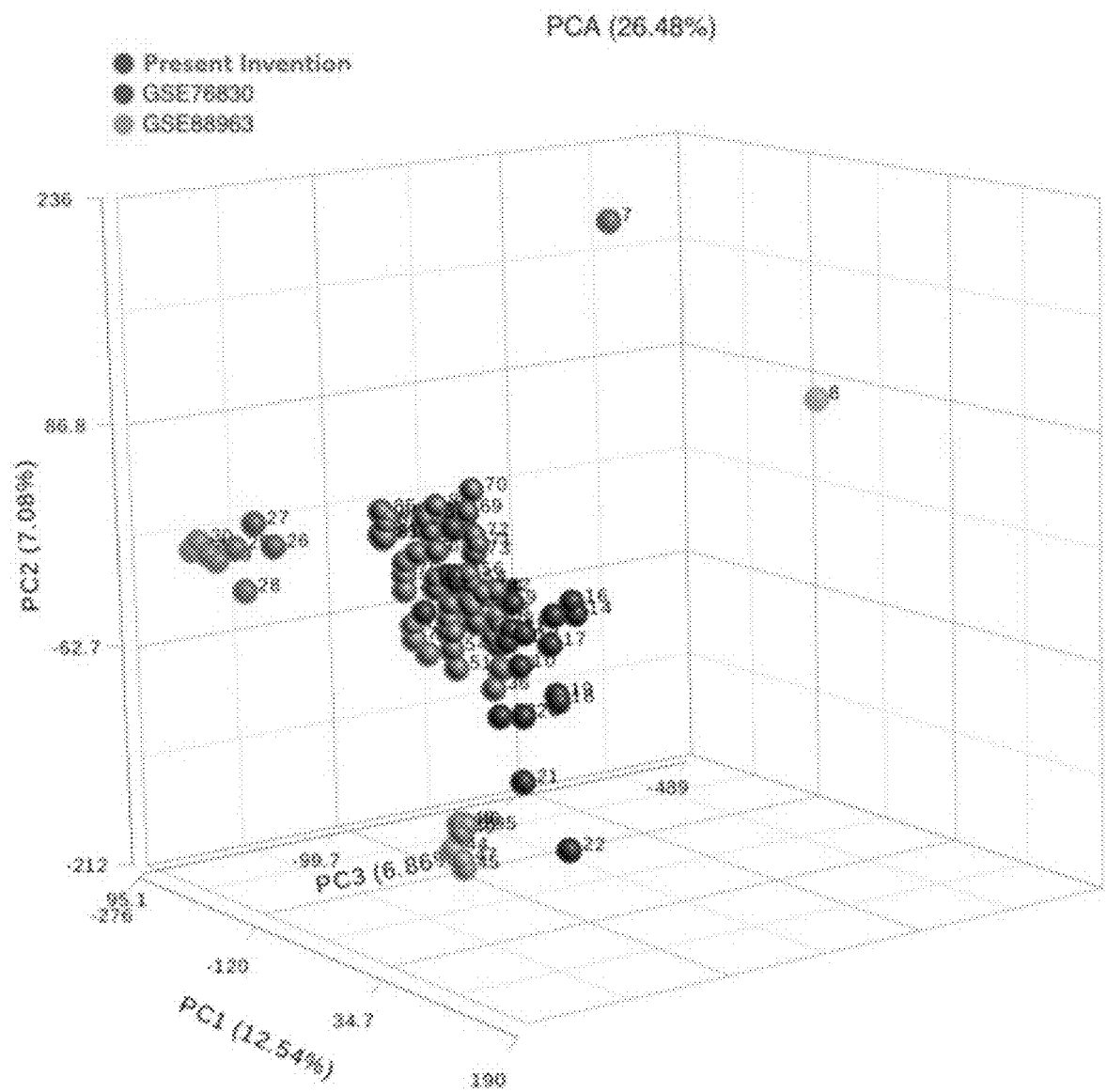

Human hepatocyte cells transduced with lentivirally-encoded i. PRR+Numb, ii. Oct4/Sox2, or iii. PRR+ Numb, Oct4, and Sox2, cluster hierarchically and in Principal Component Analysis (PCA) plots with published pluripotent ES and IPS cells. Human hepatic cells were transduced with pLenti-SFFV-Oct4-2A-Sox2 lentivirus ($10^8$ cfu/ml), with doxycycline inducible, pReceiver-Lv 113-PRR+ Numb lentivirus, or with both lentiviruses. 4 days and 11 days after transduction with PRR+ Numb, and 1 week after transduction with Oct4/Sox2, the cells were collected, their RNA extracted and analyzed using qt-PCR and gene array (using the Human Genome U133 Plus 2.0 Array). Human hepatic cells that were electroporated with Oct4, Sox2, Nanog and Notch-1 proteins (300V, 70 pulses, 50 ug per protein), or overexpressing the long PRR+ Numb isoform, clustered hierarchically in Heatmaps (FIG. 13A) and in Principal Component Analysis (PCA) plots (FIG. 13B) amongst published, pluripotent ES and iPS cells (GSE76830 and GSE88963).

Reactome analysis reactome.org was further performed based on the results of the gene array analysis and revealed that treated cells showed enriched or overexpressed genes in, for example the Cell Cycle pathways and Developmental pathways (including the Transcriptional regulation of pluripotent stem cells sub-pathway).

Example 33

Protein electroporation according to the Method of Koken et al., 1994 (300V) provides delivery of protein at high concentrations to the interior of 3T3 cells for rapid (24-72 hr), efficient (100%) and durable (>60 days), cell reprogramming. Seventy, 300V pulses were delivered for 5 ms at 100 ms intervals. (FIGS. 14A-14D, FIGS. 15A-15D, FIGS. 16A-16D).

Figure 14A:
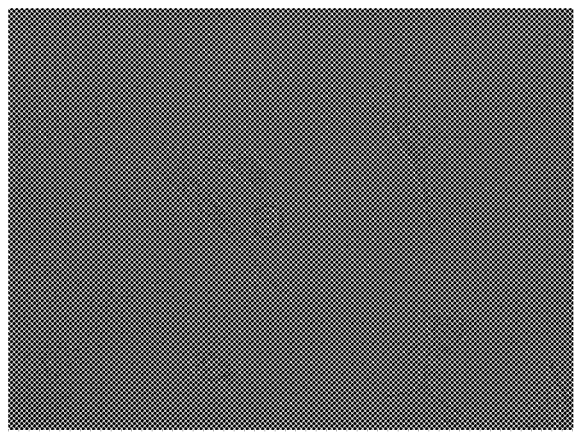
FIGS. 14A-14D illustrate pluripotency induction in approximately 3% percent of cells 24 hours cells after protein electroporation with Oct4, Sox2, and Nanog proteins (FIG. 14A and FIG. 14B), and induction in greater than 95% of cells 72 hours after electroporation (FIG. 14C and FIG. 14D), as demonstrated by GFP reporter expression under the control of the c-MYC.
Figure 14B:
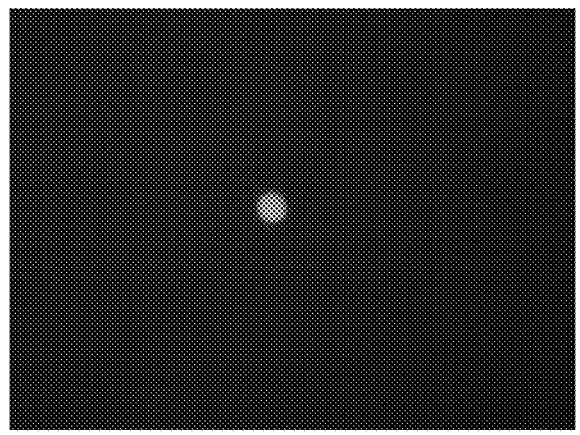
Figure 14C:
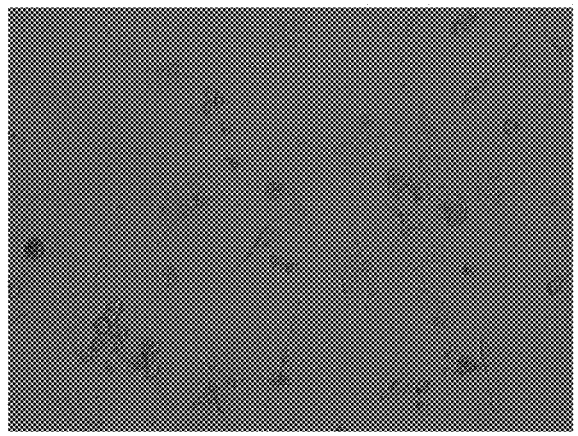
Figure 14D:
Figure 15A:
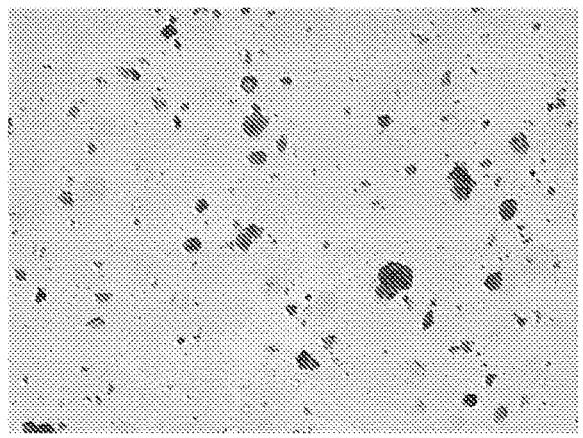
FIGS. 15A-15D illustrate that thirty days after Oct4/Sox2/Nanog Protein Electroporation of 3T3 Cells, the resulting embryoid bodies showed positive reactivity with anti-Oct4 (FIG. 15A), anti-Nanog (FIG. 15B), anti-Numb (FIG. 15C) and anti-Notch antibodies (FIG. 15D).
Figure 15B:
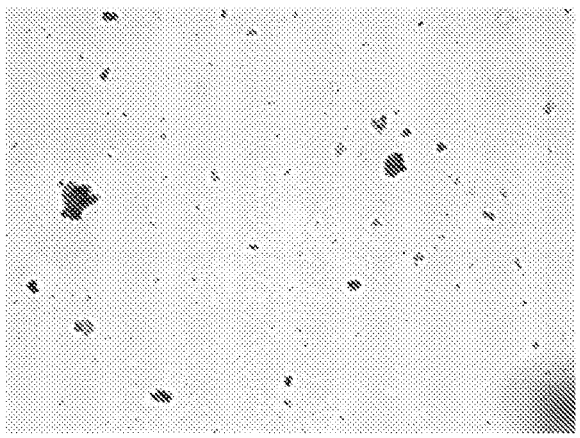
Figure 15C:
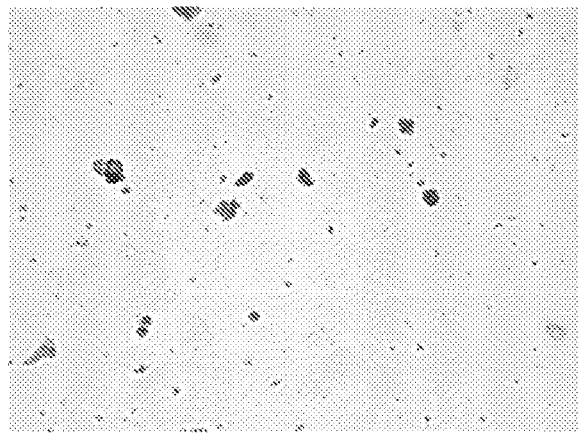
Figure 15D:
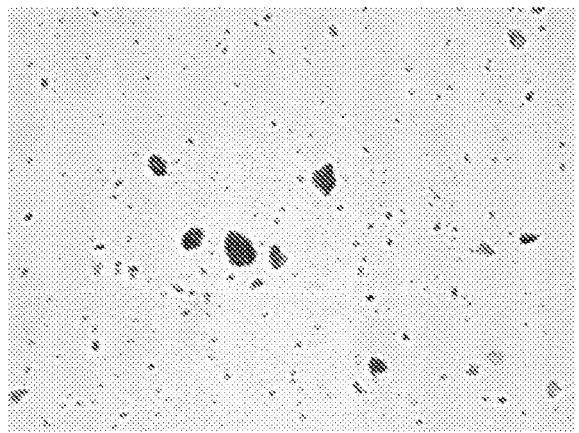

Less than 24 hours after protein electroporation with Oct4, Sox2, and Nanog proteins, approximately three percent of cells showed pluripotency induction (GFP reporter expression under the control of the c-MYC promoter). FIGS. 14A, 14B show corresponding 40× brightfield and Fluorescence images. In contrast, 72 hours after protein electroporation (FIGS. 14C, 14D), >95% cells show pluripotency induction (c-MYC/GFP stem reporter expression (ABM)). Thirty days after Oct4/Sox2/Nanog Protein Electroporation of 3T3 Cells, the resulting Embryoid bodies showed positive reactivity with anti-Oct4 (FIG. 15A), anti-Nanog (FIG. 15B), anti-Numb (FIG. 15C) and anti-Notch (FIG. 15D) antibodies.

Figure 16A:
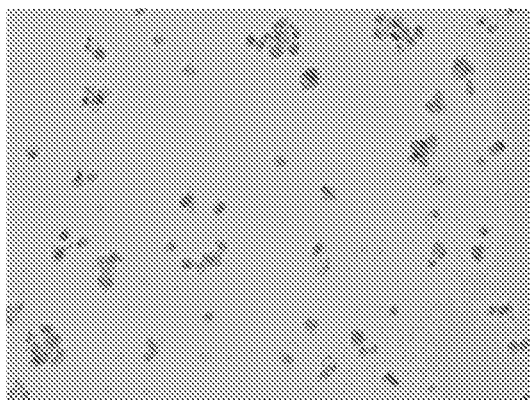
FIGS. 16A-16D illustrate that after electroporation with Oct4, Sox2 and Nanog proteins (50 ug each) in PBS with seventy, 5 ms pulses at 300V, >95% of mouse 3T3 cells were activated to adopt rounded, stem cell morphologies and form small colonies by day six (FIG. 16A), large embryoid bodies day 40 (FIG. 16B and FIG. 16C), and rafts of embryoid, day 57 (FIG. 16D).
Figure 16B:
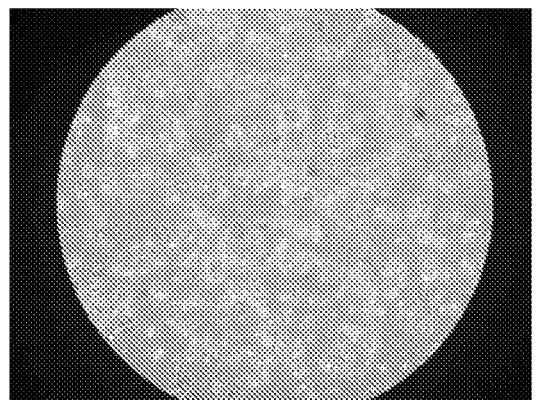
Figure 16C:
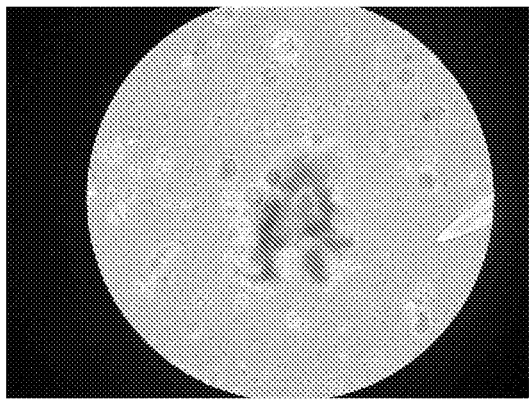
Figure 16D:
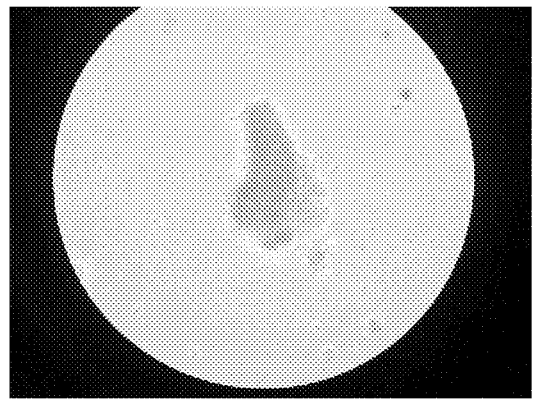

After electroporation with Oct4, Sox2 and Nanog proteins (50 ug each) in PBS with seventy 5 ms pulses at 300V, 100% of mouse 3T3 cells were activated to adopted rounded, stem cell morphologies and and form small colonies by day six (FIG. 16A), large embryoid bodies on day 40 (FIG. 16B and FIG. 16C), and large rafts of embryoid by day 57 (FIG. 16D).

Example 34

Construction of the pLenti6-MSGW/EmGFP-Bsd/EF1a/miR-decoy HIV Gene Therapy Vector. Subcloning of the EmGFP-Bsd cassette from pcDNA™6.2/EmGFP-Bsd/V5-GW/CAT into the final vector was confirmed by Restriction Digestion (FIG. 17A). The pLenti6-MSGW/EmGFP-Bsd/EF1a/miR-decoy vector comprises HIV RRE and TAR decoy sequences, miRNA sequences directed against HIV co-receptors, CCR5 and CXCR4 and the HIV-2 psi sequence, all of which confer resistance to various human and animal immunodeficiency viruses. Virus stock was prepared from transfected 293FT cells. Successful transfection was confirmed by visualizing syncitia formation at 72 hours (FIG. 17B) versus control (FIG. 17C).

Example 35

Combination of Long PRR+Numb transfection with Notch and/or Oct4/Sox2/Nanog Protein electroporation (per Koken et al., 1994, 300V, 70 pulses, 5 ms pulse length, 100 ms pulse interval) produces the claimed effect (FIGS. 18A-18F, 19).

Protein Electroporation

Figure 18A:
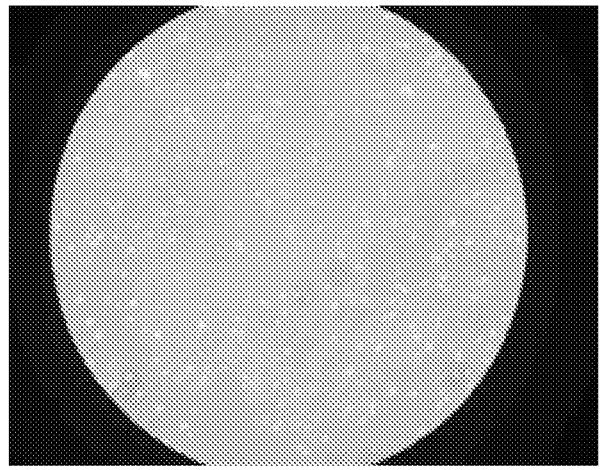
FIGS. 18A-18F illustrate that combination of long PRR+Numb transfection with Notch and/or Oct4/Sox2/Nanog protein EP (300V, 70 pulses, 5 ms pulse length) produces the claimed effect.
Figure 18B:
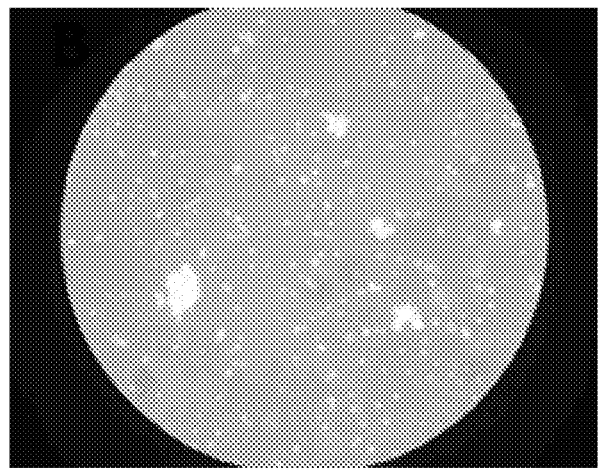
Figure 18C:
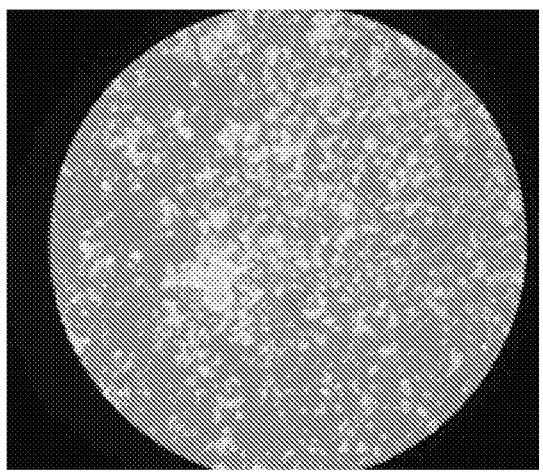
Figure 18D:
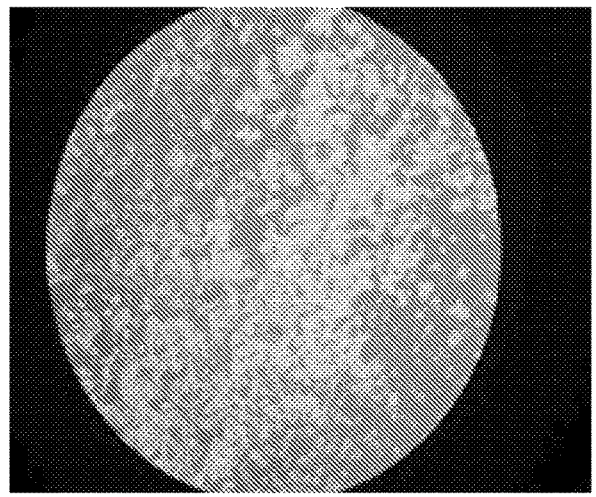
Figure 18E:
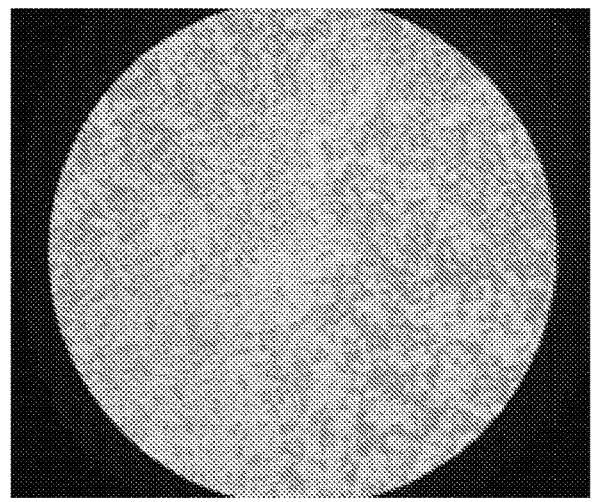
Figure 18F:
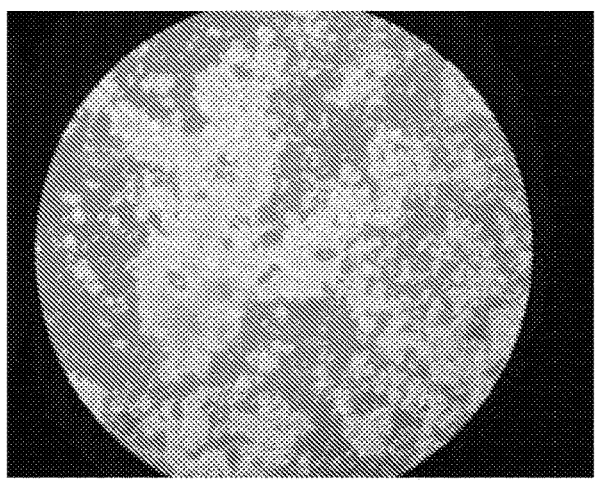

Equal numbers (~200,000) of 3T3 cells and 3T3-PRR+ Numb overexpressing cells were electroporated only with: i) Notch protein; ii) Oct4, Sox2, and Nanog proteins; or iii) Notch, Oct4, Sox2, and Nanog proteins. On day thirty (30), non-adherent and floating, reprogrammed cell colonies were collected and resuspended in equal volumes of medium for low power (10×) visual comparison of cell reprogramming efficiencies: Control (FIG. 18A), Numb (FIG. 18B), Numb/Oct4/Sox2/Nanog (FIG. 18C), Numb/Notch (FIG. 18D), as well as, Numb/Notch/Oct4/Sox2/Nanog (FIG. 18E), and Notch/Oct4/Sox2/Nanog (FIG. 18F). In all of the experimental conditions, Oct4, Sox2, Nanog and/or Notch proteins (alone or in combination with transfected PRR+Numb) reprogrammed the cells such that they were shown to be newly-positive for SSEA3, SSEA4, and Tra-1-81 antigens, indicative of pluripotent stem cells, as well as endogenous Oct4, Sox2, Nanog and PRR+Numb proteins.

Figure 19:
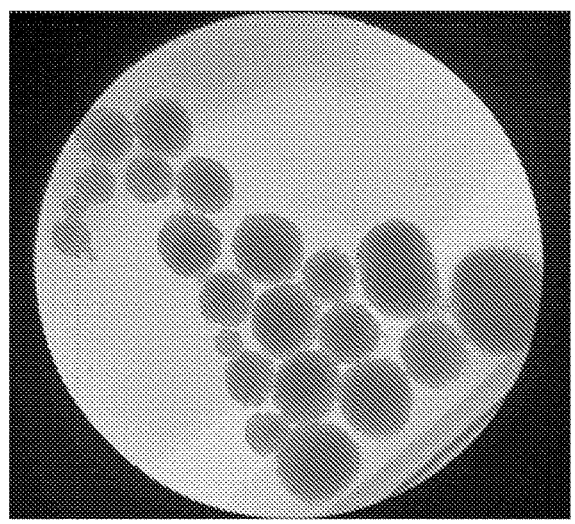
FIG. 19 illustrates an embryoid bodies 35 days post electroporation.

FIG. 19 illustrates an embryoid bodies 35 days post electroporation. A single round of electroporation according to the method of Koken et al. (1994), in the presence of Oct4, Sox2, Nanog, and Notch proteins (50 ug each) (Abcam), consistently reprogrammed cells with high efficiency (~100% in some experiments) to form colonies, embryoid, and VSEL-like cells, consistent with pluripotency or a "pluripotent-like" state.

Example 36

Figure 2A:
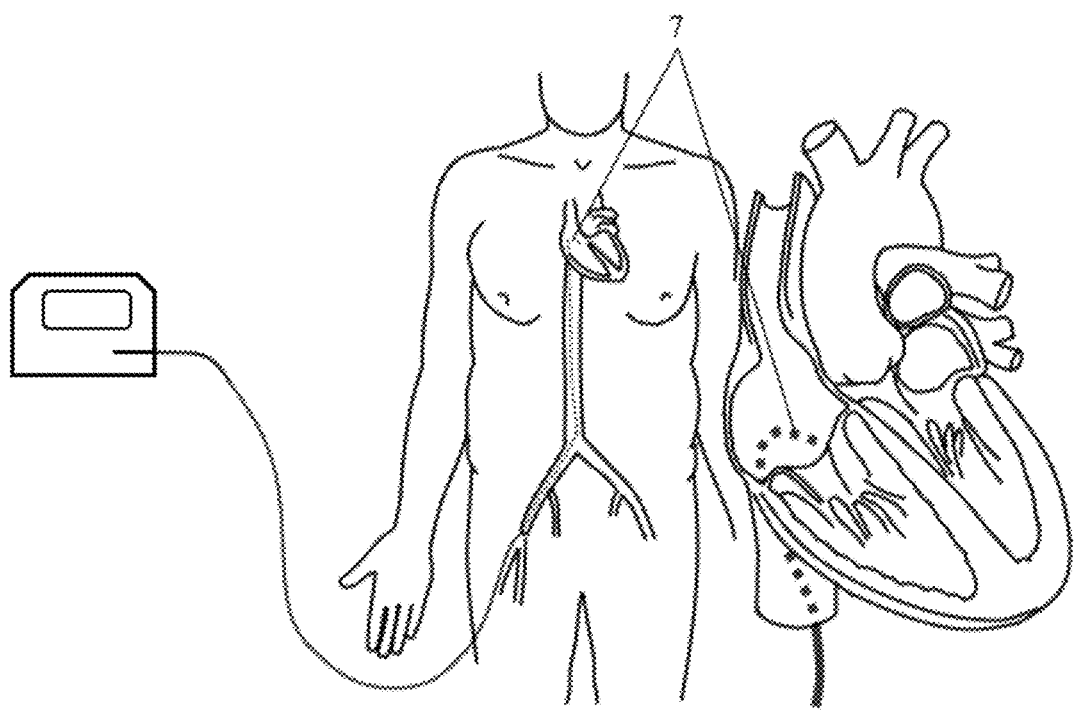
FIG. 2A illustrates a catheter style electoporation apparatus suitable for in vivo electroporation with protein and other transfectants.
Figure 2D:
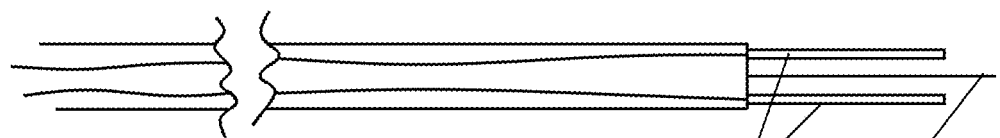
FIG. 2D illustrates a loop or circular electrode array which is used in the catheter (shown in FIG. 2C) suitable for in vivo electroporation.
Figure 2D:
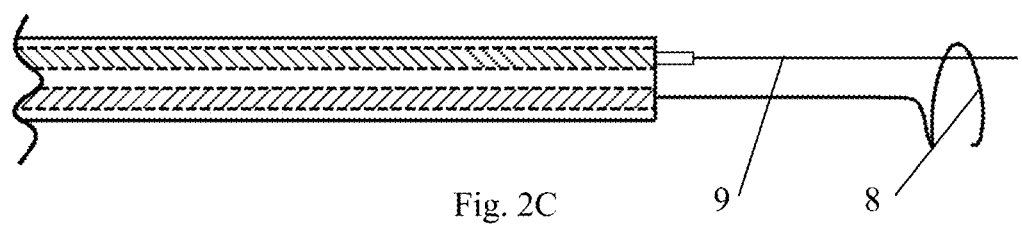
Figure 2D:
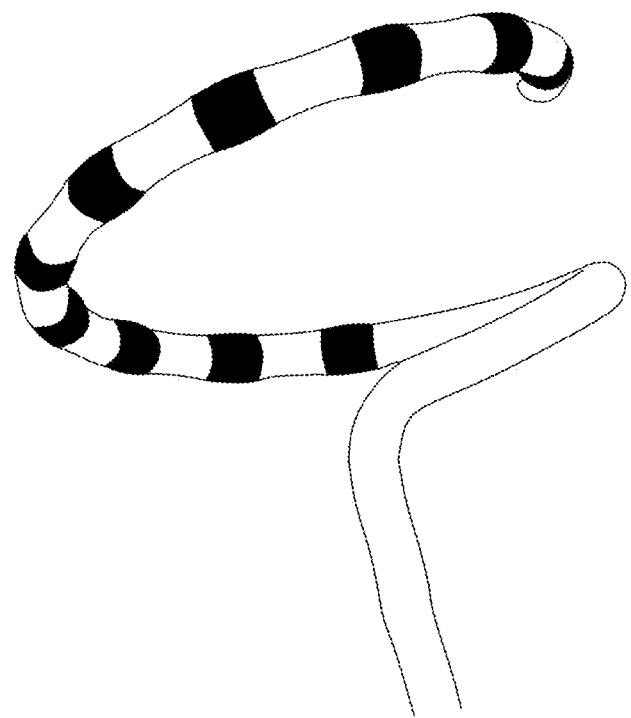

A catheter style electroporation apparatus suitable for in vivo electroporation with protein and other transfectants consisting of a needle through which a protein, nucleic acid, drug or other transfectant may be administered to a tissue (FIG. 2A).

This apparatus may include some variants of catheter 7 (FIG. 2B and FIG. 2C). FIG. 2A shows the variant of catheter style electroporation apparatus with variant of catheter 7 with needle 9 and two electrodes 8 (see FIG. 2B). FIG.

2D illustrates a loop or circular electrode 8 array which is used in catheter 7 (showed on FIG. 2C) suitable for in vivo electroporation.

The needle 9 is i) situated between two electrode 8 prongs (which may be either sharp or dull) as shown in FIG. 2B, or the needle is ii) accompanied by a single internal electrode 8 (FIG. 2C) that is used in conjunction with an external electrode (as commonly occurs with cardiac ablation), or the needle doubles as a first electrode iiia. and a second electrode is located alongside it, or iiib. a second electrode is located externally, or iiic. a second electrode is connected to a separate accompanying catheter. The separate accompanying catheter may also comprise a needle for delivering transfectant that doubles as a second electrode. The setup overall is akin to the setup uses for cardiac ablation, except that voltage is applied locally for cellular permeabilization and uptake of the transfectant.

Figure 1E:
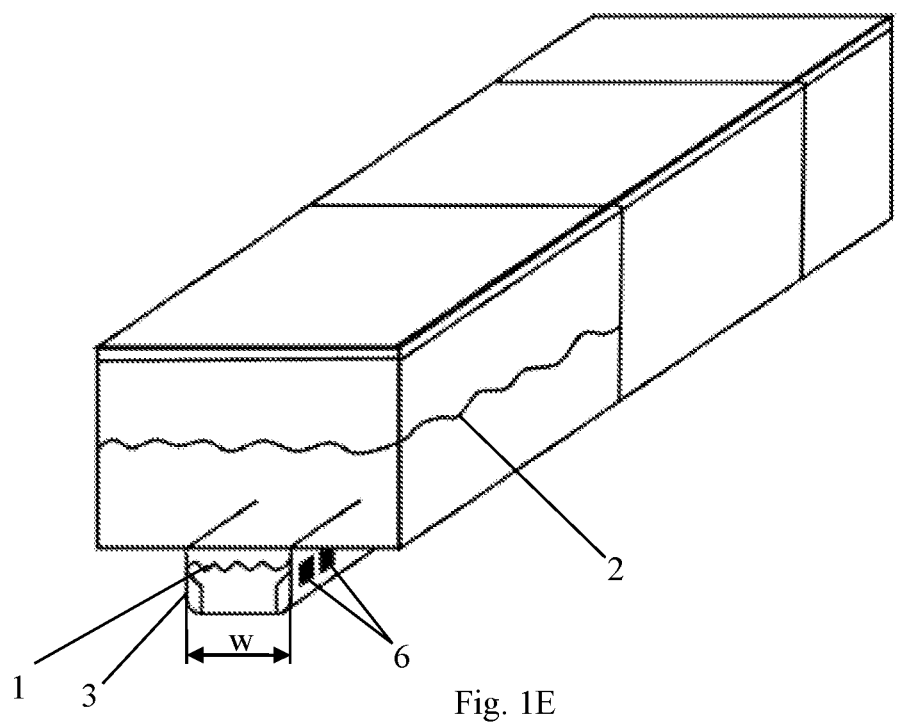
FIG. 1E illustrates an assembly of sample cell culture dishes (number of dishes may vary for example from 1 to 1,600) wherein each has a "reservoir" portion that functions like a typical electroporation cuvette and broader portion ("inspection plane") which functions like a traditional cell culture plate.

FIG. 1E illustrates an assembly of sample cell culture dishes (number of dishes may vary for example from 1 to 1,600) wherein each has a "reservoir" 3 portion that functions like a typical electroporation cuvette and broader portion ("inspection plane") 5 which functions like a traditional cell culture plate. An assembly may feature one or more plate covers. The dimensions (including width) of the reservoir 3 may vary and approximate the dimensions and materials of traditional electroporation cuvettes allowing for example, for 1 mm, 2 mm, 4 mm, 6 mm gaps, etc. In some embodiments, the electrode contact 6 is visible along the side of the reservoir 3. "w" indicates width of reservoir 3 of dish.

The reservoirs 3 and inspection planes 5 may take various shapes (FIGS. 1A-1D) and be positioned centrically or eccentrically relative to one another. FIGS. 1A, 1C and 1D show additional "feet" 4 along the edge of the plates that may or may not be detachable, so that the dishes will be able to stand on a flat surface. FIG. 1B shows "skirt" 4 along the edge of the plates that may or may not be detachable, so that the dishes will be able to stand on a flat surface. The various dishes may feature detachable base/stand with foot processes or skirts to provide stability. Alternatively, the dish may be manufactured with base/stand incorporated with the dish as a single piece. FIGS. 1C, 1D 1E show electrode contact 6 for electroporation.

Electroporation will typically occur in the reservoir 3. Additional media may be added before or after electroporation allowing cells to be incubated in larger volumes of media than are accommodated by the reservoir alone.

The volume of media contained in the reservoir portion is designated 1. The volume of media contained in cell culture dish overall is designated 2.

Figure 1F:
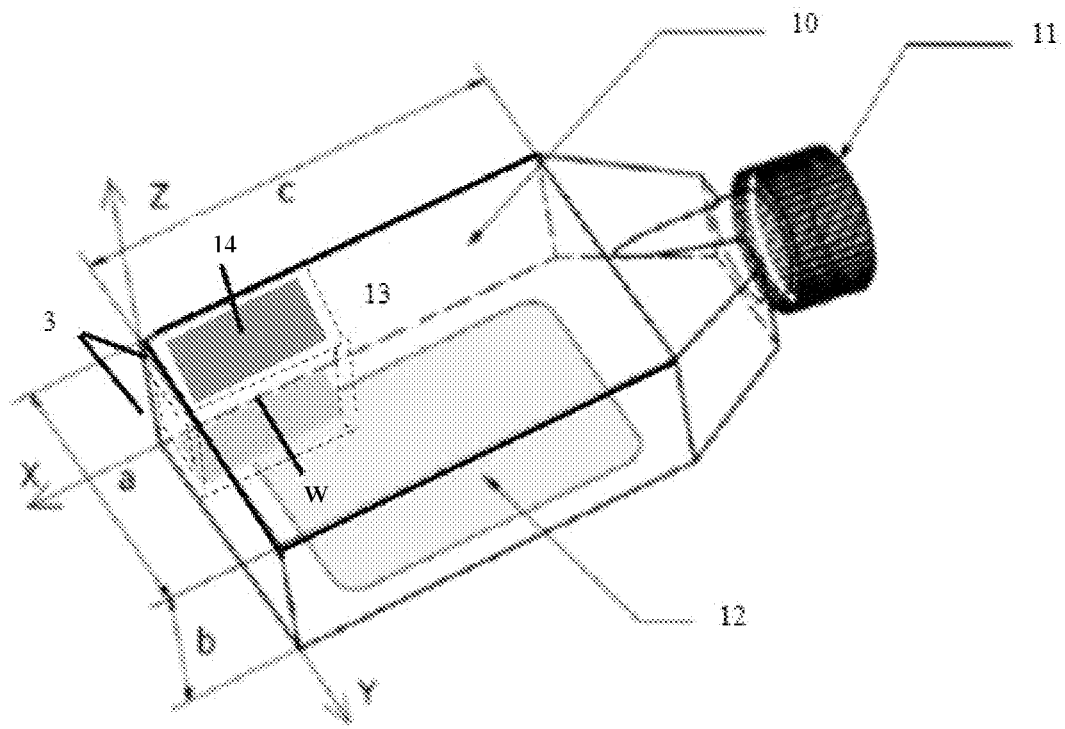
FIGS. 1F, 1G and 1I illustrate "Dish-in-Dish", cell culture flask with electroporation reservoir.
Figure 1G:
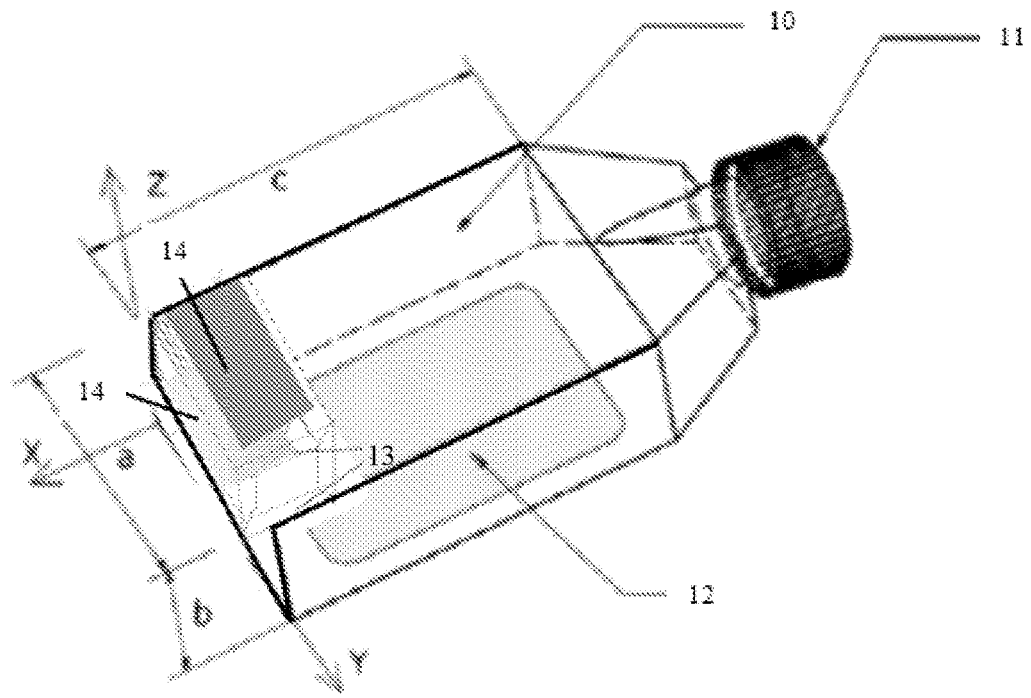
Figure 1H:
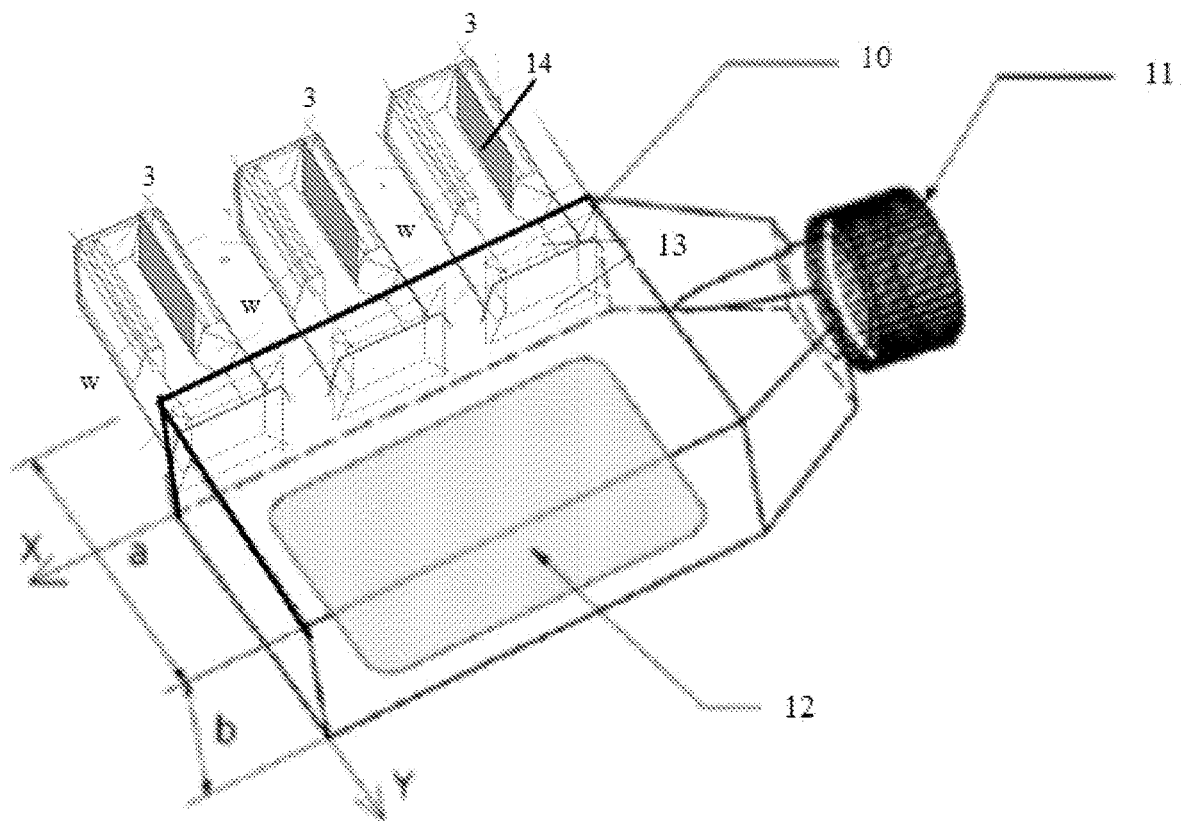
FIG. 1H illustrates "Dish-in-Dish", cell culture flask with multiple electroporation reservoirs.
Figure 1I:
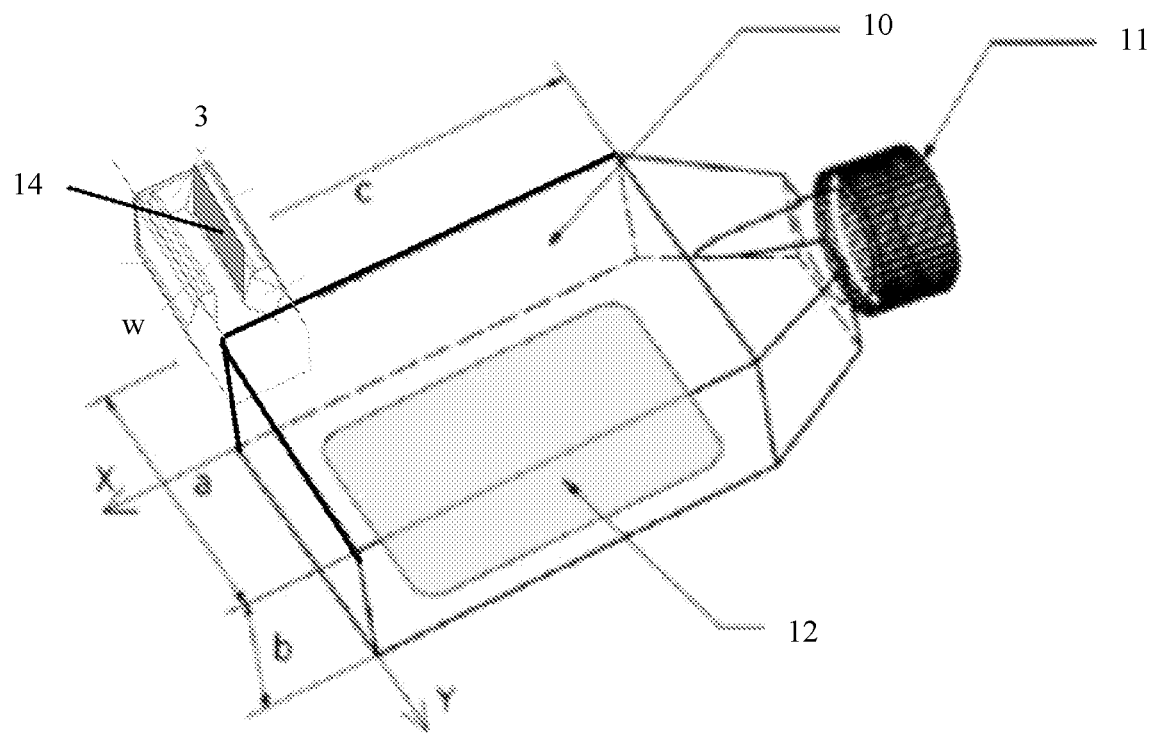
Figure 1J:
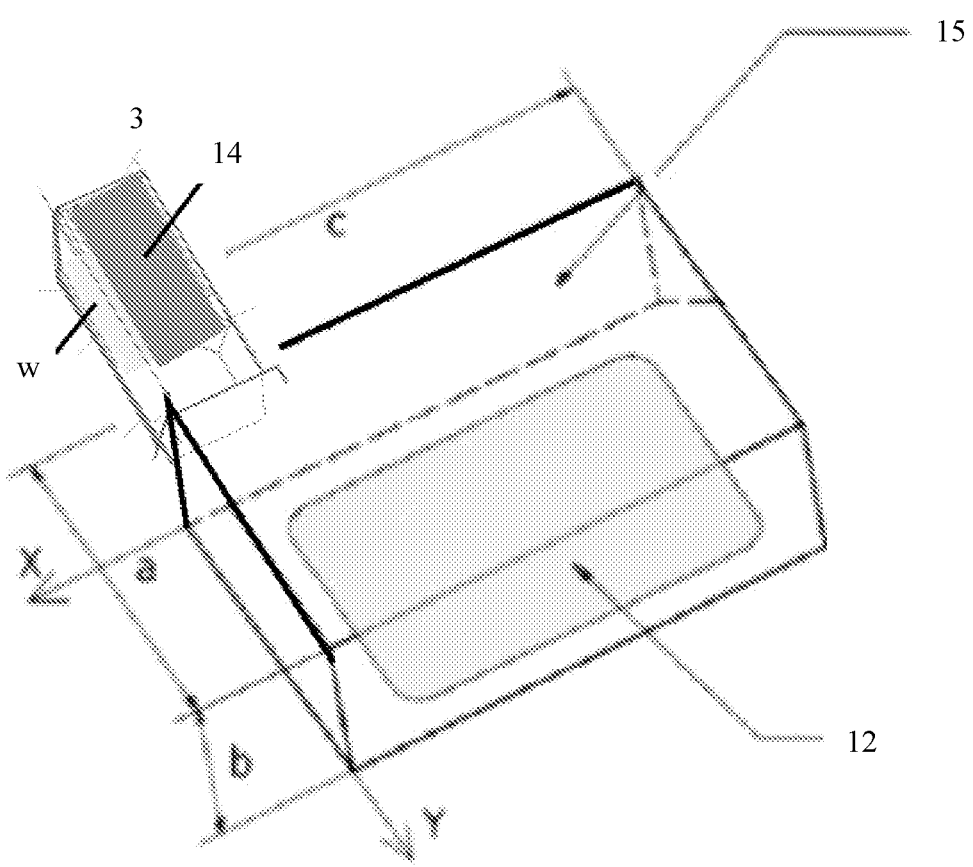
FIG. 1J illustrates "Dish-in-Dish", cell culture dish with electroporation reservoir.

FIGS. 1F, 1G, 1I illustrate "Dish-in-Dish", cell culture flask with electroporation reservoir in which 3—reservoir, 10—plastic flask, 11—cap, 12—exposition/visualization plane, 14—electrode plates, w—gap width, 13—funnel. FIG. 1H illustrates "Dish-in-Dish", cell culture flask with multiple electroporation reservoirs in which 10—plastic flask, 11—cap, 12—exposition/visualization plane, 3—reservoir, 14—electrode plates, w—gap width, 13—funnel. FIG. 1J illustrates "Dish-in-Dish", cell culture dish with electroporation reservoir in which 15—dish, 12—Exposition/Visualization plane, 3—reservoir, 14—electrode plates, w—gap width.

Example 37

Structural comparison between mouse Numblike and its mammalian Numb homologues and construction of integrase-deficient, transgene expressing lentivectors.

Figure 20A:
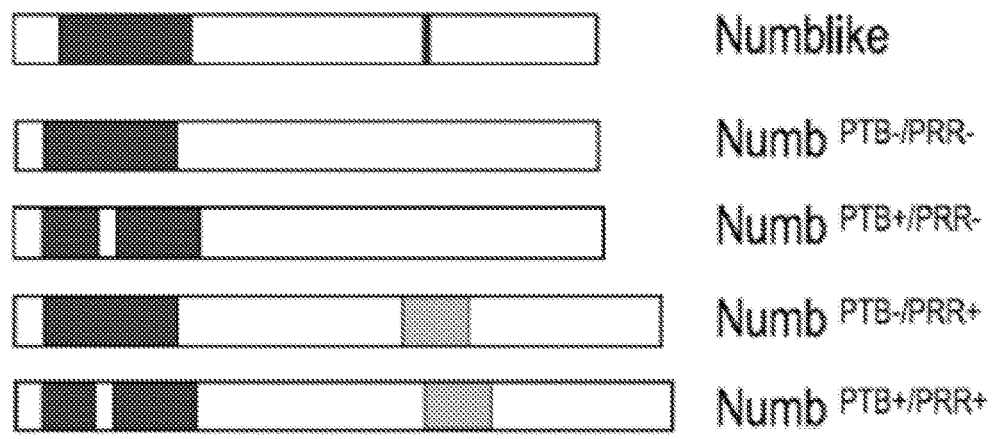
FIGS. 20A, 20B illustrate structural comparison between mouse Numblike and its mammalian Numb homologues and construction of integrase-deficient, transgene expressing lentivectors.
Figure 20B:
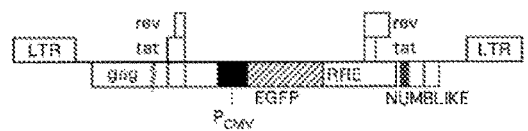
Figure 20B:
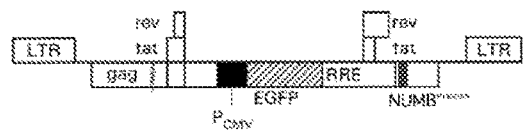
Figure 20B:
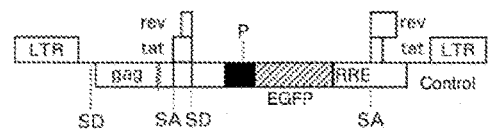

FIG. 20A illustrates that Numblike shows greater than 70% sequence identity in its amino terminal half to the shortest Numb homologue, but less than 50% identity in its cytoplasmic half where a unique 15 amino acid polyglutamine domain (purple) is found. The longest Numb isoform contains an 11 amino acid insert (white) within its phosphotyrosine binding (PTB) domain (black), as well as a 49 amino acid insert (gray) adjacent to a proline rich region (PRR). Two intermediate sized isoforms contain either the PTB or PRR inserts, but not both. The shortest Numb isoform lacks both inserts. FIG. 20B illustrates the HIV-EGFP Numblike and HIV-EGFP-NumbPTB+/PRR+vectors constructed from the two-gene HIV-EGFP-HSA vector (Reiser et al., 2000) by cloning the transgene cDNAs into nef coding region previously occupied by the mouse HSA cDNA. Abbreviations: Rev-response element (RRE), slice donor site (SD), splice acceptor site (SA).

Example 38: In Vivo Injection of the HIV-EGFP-Numblike Transfectant into the Lateral Ventricle and Subsequent Electroporation per Saito et al., (2001)

a) 72 hours after transient transfection, pairs and clusters of EGFP-positive cells were detected migrating radially in the mouse forebrain. FIG. 21A illustrates high power photograph depicting a cluster of EGFP-positive cells migrating ventrolaterally, away from the third ventricle within the developing thalamus. One cell from this cluster (FIG. 21B) displays many of the classic features associated with newly-generated, migrating neurons including bipolar morphology and a leading process with apparent pseudopodia. FIG. 21C illustrates low power image depicting a pair of EGFP-positive cells which appear to be exiting the intermediate zone (iz) and entering the cortical plate (cp). DAPI stained nuclei are depicted in blue. These highly similar cells expressed EGFP (green) in their cell bodies as well as their pial directed, leading processes (arrowheads) (FIG. 21D). This pair also expressed HuC/D (red), a marker of newly generated, migrating and immature neurons, in their cell bodies and processes (FIG. 21E). Higher magnification of inset depicted on FIG. 21C is shown on FIG. 21F (Scale bar=10 um). b) FIG. 22A depicts a 3D reconstruction of the E18 cortical plate derived from high power z series images. Numerous EGFP-positive cells (green) demonstrate morphologies and location consistent with differentiating neurons. FIGS. 22B and 22C show higher magnifications of insets illustrated on FIG. 22A. These cells were identified as neurons according to their co-expression of the neuronal class III beta-tubulin (red). DAPI stained nuclei are shown in blue. A similar 3D reconstruction is shown on FIG. 22D. Higher magnification of insets illustrated on FIG. 22D is shown on FIG. 22E and FIG. 22F. (Scale bar=50 um).

Example 39: In Vivo Injection Followed by Electroporation of Mouse Ventricular Zone Cells at P0 with HIV-EGFP Numblike Versus HIV-EGFP Control Vector Upper left corner of FIG. 23A shows a low power image of the hypothalamic third ventricle (Hy 3V) rotated so that the electroporated portion of the ventricular neuroepithelium is upwards, and the superior portion of the ventricle is to the right. Radially-oriented, EGFP-positive cells (radial glia transfected with control) are seen lining the ventricle and represent the majority of cells labeled by control (~80%). Their long EGFP-positive processes are observed to extend to the pia within the plane of section. A smaller proportion of cells were located at or near the pial margin-always closely associated with labeled radial processes. Middle section of FIG. 23A depicts cells transfected with HIV-EGFP-Numblike at P0. Forty-eight hours later, virtually all of the cells have migrated away from the ventricle consistent with their new identity as differentiating neurons. Many of the cells dispersing away from the ventricle showed morphologies and trajectories consistent with the classical appearance of radially migrating neurons. Lower right corner of FIG. 23A shows a higher magnification of the inset from middle section of FIG. 23A and depicts an EGFP-positive cell with features characteristic of migrating neurons, including bipolar morphology, a thick leading process with pseudopodia, and a thin lagging process. Abbreviations: Th3V=thalamic portion of the third ventricle. FIG. 23B shows a 3D reconstruction derived from 180 high power, z-series images of the thalamic third ventricle. P2 germinal zone cells, including those transfected with control vector and displaying radial glial morphology, consistently expressed GLAST (glial glutamate transporter) in their cell membranes. FIG. 23C shows the radial glial cell depicted in the inset illustrated on FIG. 23B at higher magnification (scale Bars=50 um on FIG. 23B and 100 um on middle section of FIG. 23A).

Example 40: Intraventricular Injection of the HIV-EGFP-Numblike Transfectant Followed by In Vivo Electroporation Upregulates Numb Expression FIG. 24A illustrates a 3D reconstruction depicting a section 50 um. EGFP labeled cells, both within and beyond the germinal zone, showed increased Numb immunoreactivity (red) relative to non-transfected cells in the same section (FIG. 24B). A portion of the germinal zone is shown at higher magnification in lower right corner on FIGS. 24A, 24B. The insets again show a relatively disorganized ventricular zone following transfection. This disorganization may have been related to the emigration of cells previously lining the ventricle, but might also reflect tissue injury due to electroporation alone (scale bar=100 um on FIGS. 24A, 24B and 100 um in lower right corner on FIGS. 24A, 24B.

Example 41: In Vivo Injection of the HIV-EGFP-Numb$^{PTB-/PRR-}$ Transfectant Followed by Electroporation Promotes Neuronal Differentiation in Postnatal Mice FIG. 25A depicts a coronal section through dorsal neocortex in a P3 mouse transfected with the HIV-EGFP-Numb$^{PTB-/PRR-}$ forty-eight hours earlier. Dapi-stained nuclei in the region of electroporation indicated large numbers of cells (arrows) migrating radially through the various layers of the cerebral cortex including the subventricular zone (SVZ), corpus callosum (CC), subplate (SP), and cortical plate (CP). FIG. 25B illustrates EGFP expressing cells (triangles) also appeared to migrate laterally in the intermediate zone (IZ) as is known to occur during normal development. Most EGFP-positive cells also expressed high levels of Hu C/D, indicating they were newly-generated neurons (not shown). A 3D reconstruction from confocal z-series images shows HIV-EGFP-Numb$^{PTB-/PRR-}$ transfected cells in the P3 thalamus (FIG. 25C). Most of the cells are located outside the germinal zone 48 hours later, and can be recognized as migrating neurons by their morphologies and increased expression of Hu C/D—having been induced to begin differentiating simultaneously following electroporation and to migrate as a cohort. Other cells nearer the ventricle show migratory profiles and appear to be exiting the VZ, but have not yet begun to express Hu C/D (arrowheads). Scale bar=100 um on FIG. 25A and 40 um on FIG. 25C.

Figure 26C:
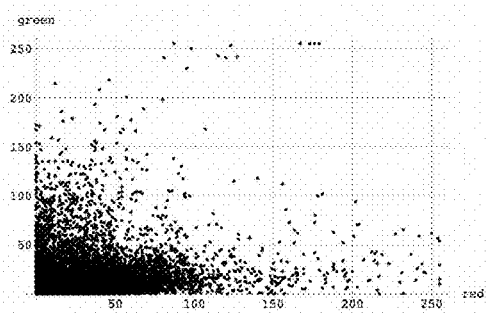
Figure 26D:
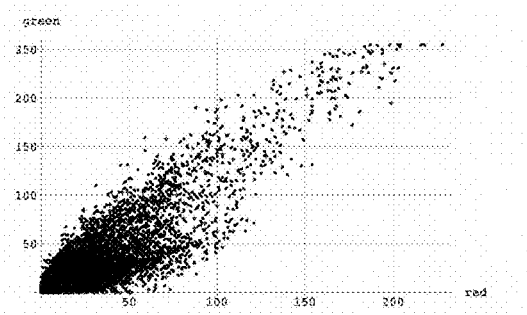
Figure 26E:
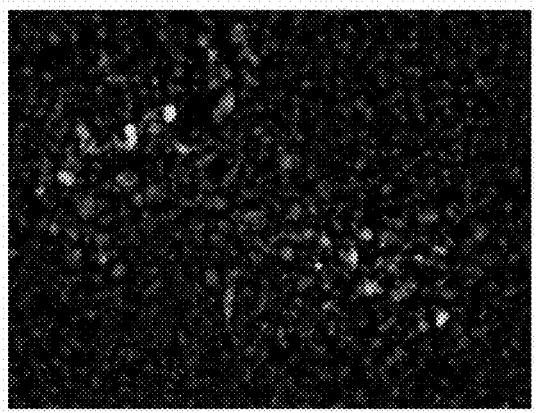
Figure 26F:
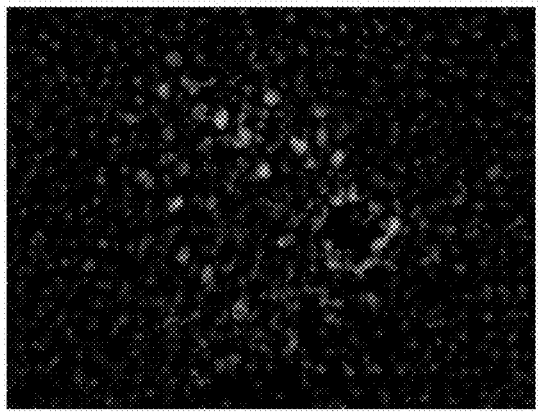
Figure 26G:
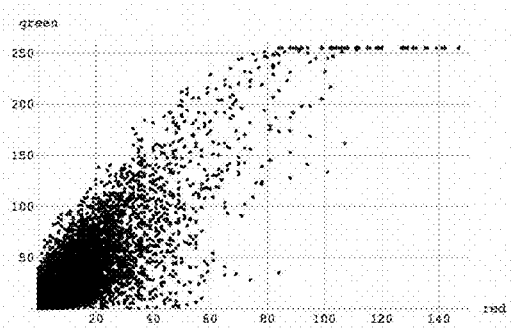
Figure 26H:
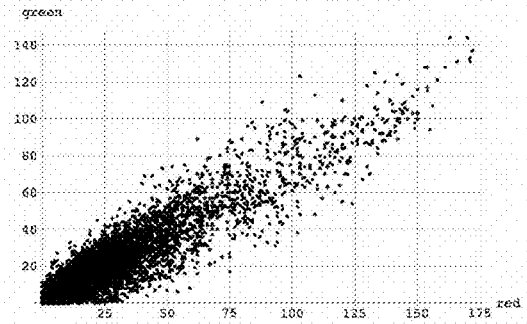

Example 42: Transiently Expressed EGFP Strongly Correlates with Markers of Neuronal Differentiation in Cells Transfected with Numblike Following In Vivo Injection All EGFP positive cells were analyzed immunohistochemically. A discrete cluster of EGFP-positive cells located in the thalamus, 600-700 microns dorsolateral to the germinal zone is depicted. Consecutive sections containing cells from this cluster were stained for markers of neural differentiation including GLAST (FIG. 26A), Numb (FIG. 26B), TUJ (FIG. 26E), and DCX (FIG. 26F). Subsequent pixel-by-pixel analysis of these images demonstrated strong correlation between EGFP intensity (green) and markers of neuronal differentiation (red) (R-squared values≥0.76). On the other hand, EGFP expression was not correlated with expression of the immature marker, GLAST (FIG. 26C: R-squared value=0.1079). DCX (FIG. 26H) showed the highest correlation (R-squared value=0.909), while Numb reactivity was also strongly correlated with EGFP expression in Numblike transfected cells (FIG. 26D: R-squared value=0.76). Brains of animals injected with transfectants and electroporated in vivo at P0 were sectioned to completion and inspected microscopically. While large clusters of neurons transfected at P0 with Numb or Numblike were detected within each of the brains, having migrated and differentiated as a cohort, they no longer expressed EGFP-evidence that the integrase deficient lentivectors remained episomal (did not integrate) and produced only transient transfection.

Figure 27A:
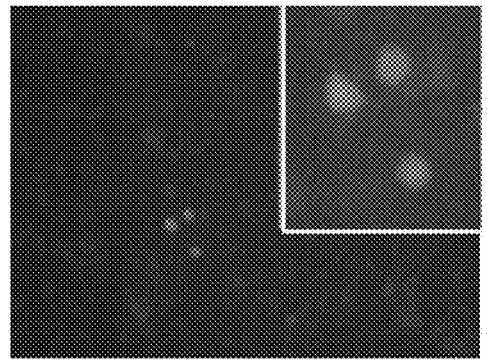
FIGS. 27A-27F illustrate that HIV-EGFP-Numb PRR-/PTB- (FIGS. 27B and 27E) and HIV-EGFP-Numblike (FIGS. 27C and 27F) lentiviruses reduce proliferation and promote differentiation in Ras+, Breast cancer cells versus control.
Figure 27D:
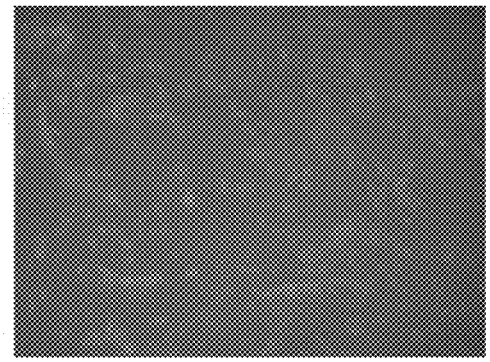
Figure 27B:
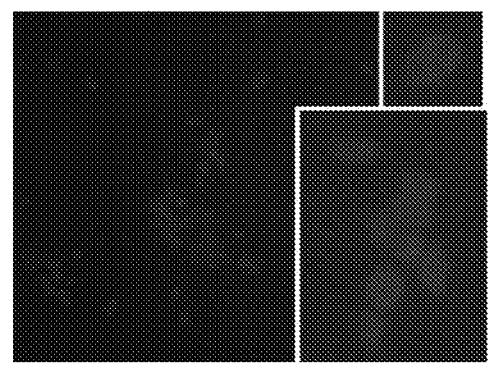
Figure 27E:
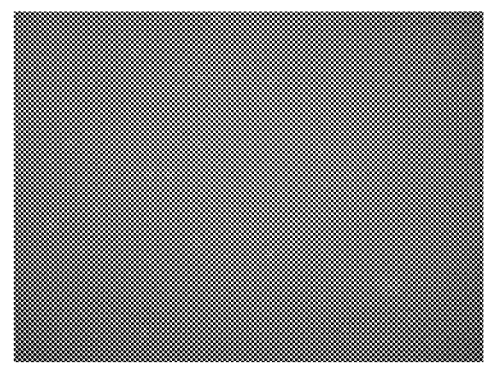
Figure 27C:
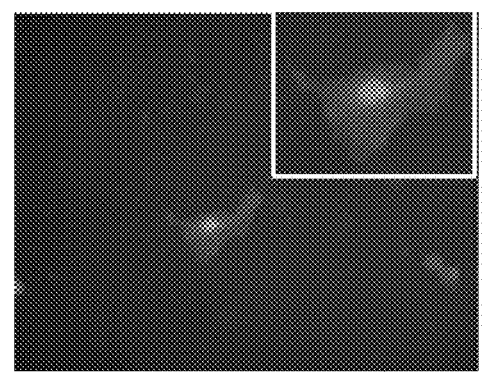
Figure 27F:
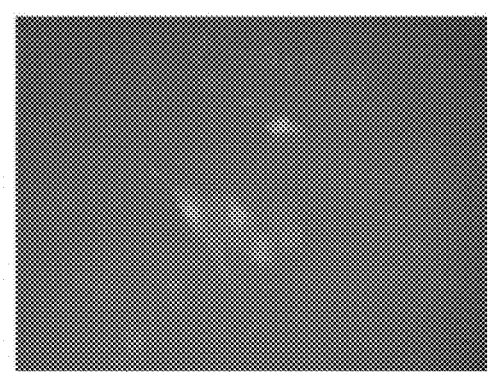

Example 43: HIV-EGFP-Numb$^{PRR-/PTB-}$ and HIV-EGFP-Numblike Lentiviruses Reduce Proliferation and Promote Differentiation in Ras +, Breast Cancer Cells At 5 days post-transduction/post-plating, Ras+ cancer cells transduced with control HIV-EGFP lentivirus showed rapid proliferation and chaotic morphologies (FIG. 27A). The inset shows three round, brightly fluorescing cells whose appearance was consistent with cancer stem cells. In contrast, cells transduced with HIV-EGFP-Numb$^{PRR-/PTB-}$ showed evidence of symmetrical, terminal divisions (cell pairs) on day 5, as well as reduced proliferation (FIG. 27B). In addition to blocking proliferation, transduction with HIV-EGFP-Numblike induced Ras+ cancer cells to adopt a phenotype consistent with normal breast epithelial cells (FIG. 27C). At 10 days post-plating/post-transduction, Ras+ cancer cells transduced with control virus fluoresced more brightly than on day 5, but otherwise, continued to show the disorganization characteristic of breast cancer cells, in vitro (FIG. 27D). In contrast, on day 10, few, mostly small cells were present in with HIV-EGFP-Numb$^{PRR-/PTB-}$ transduced culture (FIG. 27E). Meanwhile, additional cells reverting to a normal, breast epithelial phenotype were identifiable in HIV-EGFP-Numblike transduced cultures (FIG. 27F).

Example 44: Examples of Expressed or Targeted Transgenes Utilized in the Present Invention Any transgene sequences (or their corresponding proteins) effective in fulfilling the present invention is suitable for use in the present invention. Suitable nucleotide sequences (or their corresponding proteins) may be drawn from any species so long as the desired cells or behavior is achieved. Likewise, the method of naming such sequences (or their corresponding proteins), either in lower case or upper case letters herein, does not imply a particular species. The sequences included in the accompanying sequence listing and stored in the NCBI database (listed by accession number) represent examples of sequences referenced above in the present application. They are also examples of specific transgene encoding sequences (cds) suitable for use in the present invention, but do not in any way limit the practice of the invention.

cardiotrophin1:U43030 (SEQ ID NO: 18). CNTF: BC074964 (SEQ ID NO: 19). GP130:NM_175767 (SEQ ID NO: 20). IL6:BC015511 (SEQ ID NO: 21); AB107656. HOXB4:NM_024015 (SEQ ID NO: 22); NM_010459. IL6R:NM_000565 (SEQ ID NO: 23); NM_181359. IL11: NM_133519 (SEQ ID NO: 24); NM_008350. LIF: NM_002309 (SEQ ID NO: 25); NM_008501; BB235045.

LIFR:NM_002310 (SEQ ID NO: 26). STAT3: NM_003150 (SEQ ID NO: 27); NM_213662; NM_139276. NUMB: AF171938 (SEQ ID NO: 28); AF171939 (SEQ ID NO: 29). AF171940 (SEQ ID NO: 30); AF171941 (SEQ ID NO: 31); NM_010949; NM_133287; BB483123; NM_010950; NM_010949; NM_004756; DQ022744. Numblike:NM_00475 (SEQ ID NO: 32); U96441; NM_010950; DQ022744. NANOG:NM_024865 (SEQ ID NO: 33); BC137873; NM_028016;

OncostatinM(OSM):NM_020530 (SEQ ID NO: 34). OSMR:NM_003999 (SEQ ID NO: 35); NP_003990.1 OCT3/4(POU5F1):NM_203289 (SEQ ID NO: 36); NM_002701 (SEQ ID NO: 37). SOX2:NM_003106 (SEQ ID NO: 38). FGF4:NM_002007 (SEQ ID NO: 39); NP_604391 Gata2:NM_032638 (SEQ ID NO: 40). Gata3: NM_001002295 (SEQ ID NO: 41). Gata4:BC101580 (SEQ ID NO: 42). Gata5:BC117356 (SEQ ID NO: 43). Gata6: NM_005257 (SEQ ID NO: 44). HNF1:NM_000458 (SEQ ID NO: 45); NM_012669 (SEQ ID NO: 46). HNF3:X74936 (SEQ ID NO: 47). HNF3gammaX74938M (SEQ ID NO: 48). HNF3betaX74937 (SEQ ID NO: 49). HNF3G: AH008133 (SEQ ID NO: 50). HNF3A:AH008132 (SEQ ID NO: 51). HNF4alpha:NM_008261 (SEQ ID NO: 52). HNF4a:NM_022180 (SEQ ID NO: 53). HNF6:U95945 (SEQ ID NO: 54). HLXB9:NM_001096823 (SEQ ID NO: 55); NM_019944. (SEQ ID NO: 56). NM_005515 (SEQ ID NO: 57). Lbx1:NM_006562 (SEQ ID NO: 58); NM_010691. Lmx1b (SEQ ID NO: 59); NM_010725 Neurogenin(NEUROG1):NM_006161 (SEQ ID NO: 60); BQ169355. Neurogenin2(NEUROG2):NM_024019 (SEQ ID NO: 61); DR001447. Neurogenin3(NEUROG3) (SEQ ID NO: 62); NM_009719. MASH1:NM_004316 (SEQ ID NO: 63). MyoD:NM_010866 (SEQ ID NO: 64); NM_002478 (SEQ ID NO: 65).

Myf5:NM_005593 (SEQ ID NO: 66); NM_131576.

Myf6:NM_002469 (SEQ ID NO: 67). NM_008657; NM_008657; NM_013172. Ifrd1:NM_001007245 (SEQ ID NO: 68). Mef2A:NM_013172 (SEQ ID NO: 69).

Myogenin:NM_002479 (SEQ ID NO: 70). Nkx2.2: NM_002509 (SEQ ID NO: 71).

Notch. Notch1:NM_017617 (SEQ ID NO: 72). NOTCH2:NM_024408; NM_010928. NOTCH3: NM_000435 (SEQ ID NO: 73). Nurr1:NM_006186 (SEQ ID NO: 74). NOV(CCN3):NM_002514 (SEQ ID NO: 75). OLIG1:NM_138983 (SEQ ID NO: 76); OLIG2: NM_005806 (SEQ ID NO: 77).

Pdx1:NM_000209 (SEQ ID NO: 78); Pet1(FEV): BC138435; NM_017521 (SEQ ID NO: 79). Phox2a: NM_005169 (SEQ ID NO: 80). Phox2b:NM_003924 (SEQ ID NO: 81). Pit1:NM_000306 (SEQ ID NO: 82). PITX3: NM_005029 (SEQ ID NO: 83); RUNX1:NM_001001890 (SEQ ID NO: 84). Runx2:NM_001015051 (SEQ ID NO: 85); Shh:NM_000193 (SEQ ID NO: 86). Sox9:NM_000346 (SEQ ID NO: 87). Sox17:NM_022454 (SEQ ID NO: 88); BC140307; NM_011441.

DLX2:NM_004405 (SEQ ID NO: 89); NP_004396.1; NM_010054.

DLX5:NM_005221 (SEQ ID NO: 90); NM_005221; NP_005212.

HES1:NM_005524 (SEQ ID NO: 91); NP_005515.1; NM_008235; NP_032261.

FGF8:NM_006119 (SEQ ID NO: 92); NM_010205; NP_034335; NM_010205; NP_034335; NP_006110. NM_033163; NP_149353; NM_033164; NP_149354; NM_033165; NP_149355. PITX2:NM_000325 (SEQ ID NO: 93); NM_000325; NP_000316; NM_153426; NP_700475; NM_153427; NP_700476; NM_001042502; NP_001035967; NM_001042504; NP_001035969. REST4: DQ644039 (SEQ ID NO: 94). CREB_binding_protein: NM_134442 (SEQ ID NO: 95); NM_004379; NP_004370; NP_604391. Zfp488:NM_001013777 (SEQ ID NO: 96); BC089025; XM_224697; XP_224697. Foxa2:NM_021784 (SEQ ID NO: 97); NP_068556; NM_012743; NP_036875; NM_010446; NP_034576. Rnx REN:NM_000537 (SEQ ID NO: 98); dHAND(HAND2):NM_021973 (SEQ ID NO: 99); NM_010402;

aspartoacylase (Canavan disease) (ASPA):NM_000049 (SEQ ID NO: 100); NM_023113. hexosaminidaseA (HEXA):NM_000520 (SEQ ID NO: 101).

Lesch_Nyhan_syndrome(HRPT):NM_000194 (SEQ ID NO: 102); NM_204848.

Huntingtin; NM_010414; GUSB; NM_000181 (SEQ ID NO: 103); NM_010368.

NPC1:NM_000271; NM_006432. hexosaminidaseB: NM_000521 (SEQ ID NO: 104).

galactosidase,alpha(GLA):NM_000169 (SEQ ID NO: 105). glucosidase_beta_acid(GBA):NM_000157 (SEQ ID NO: 106); NM_008094. von_Hippel_Lindau_tumor_suppressor(VHL):NM_000551 (SEQ ID NO: 107). Beta_globin (HBB):NM_000518 (SEQ ID NO: 108). PARK2: NM_013988 (SEQ ID NO: 109); NM_004562; NM_020093.

The contents of all parenthetically cited publications and the following United States Patents, are noted and incorporated by reference in their entireties, including: U.S. Pat. Nos. 7,211,247, 5,677,139, 6,432,711 and 5,453,357, 5,593,875, 5,783,566, 5,928,944, 5,910,488, and 5,824,547.

SEQUENCE LISTING (238 sequences)

SEQ ID NO: 1 - DNA, 8069 bp, Artificial Sequence
  Description of Artificial Sequence: Synthetic polynucleotide
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgatgtcgacgttaacgctagtgatatcaactttgtatagaaaagttgaacgagaaacgtaaaatgatataaatatcaatatattaaattagattttgcataaaaaacagactacataatactgtaaaacacaacatatccagtcactatggcggccgcattaggcaccccaggctttacactttatgcttccggctcgtataatgtgtggattttgagttaggatccgtcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaaagatctggatccggcttactaaaagccagataacagtatgcgtatttgcgcgctgatttttgcggtataagaatatatactgatatgtatacccgaagtatgtcaaaaagaggtatgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctccgttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggttgatatccagcacagtggcggccgctcgagtctagagggcccgcggttcgaaggtaagcctatccctaaccctctcctcggtctcgattctacgcgtaccggttagtaatgagtttggaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgttgacaattaatcatcggcatagtatatcggcatagtataatacgacaaggtgaggaactaaaccatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctaagcacaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 2 - DNA, 22460 bp, Artificial Sequence
  Description of Artificial Sequence: Synthetic polynucleotide
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgatgtcgacgttaacgctagtgatatcaactttgtatagaaaagttgaacgagaaacgtaaaatgatataaatatcaatatattaaattagattttgcataaaaaacagactacataatactgtaaaacacaacatatccagtcactatgggacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggaaccaaaatcaacgggactttccaaaatgtcgtaacaactccgccccattgacgcaaatgggcggtaggcgtgtacggtgggaggtctatataagcagagctctccctatcagtgatagagatctccctatcagtgatagagatcgtcgacgagctcgtttagtgaaccgtcagatcgcctggagacgccatccacgctgttttgacctccatagaagacaccgggaccgatccagcctccggactctagcgtttaaacttaagcttaccatgccttcgcaagccctcatttcaccaggcccccggcttggggcgccttccttccccatggcgggacacctggcttcggatttcgccttctcgccccctccaggtggtggaggtgatgggccaggggggccggagccgggctgggttgatcctcggacctggctaagcttccaaggccctcctggagggccaggaatcgggccgggggttgggccaggctctgaggtgtgggggattcccccatgccccccgccgtatgagttctgtggggggatggcgtactgtgggccccaggttggagtggggctagtgccccaaggcggcttggagacctctcagcctgagggcgaagcaggagtcggggtggagagcaactccgatggggcctccccggagccctgcaccgtcacccctggtgccgtgaagctggagaaggagaagctggagcaaaacccggaggagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctccgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcctgggacacagtagatagacacacttaaaaaaaaaaacctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggacggatcgggagatctcccgatcccctatggtgcactctcagtacaatcttgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggaaccaaaatcaacgggactttccaaaatgtcgtaacaactccgccccattgacgcaaatgggcggtaggcgtgtacggtgggaggtctatataagcagagctctccctatcagtgatagagatctccctatcagtgatagagatcgtcgacgagctcgtttagtgaaccgtcagatcgcctggagacgccatccacgctgttttgacctccatagaagacaccgggaccgatccagcctccggactctagcgtttaaacttaagcttaccatgctattaacttgttcaaaaaagtatcaggagttgtcaaggcagagaagagagtgtttgcaaaagggggaaagtagtttgctgcctctttaagactaggactgagagaaagaagaggagagagaaagaaagggagagaagtttgagccccaggcttaagcctttccaaaaaataataataacaatcatcggcggcggcaggatcggccagaggaggagggaagcgctttttttgatcctgattccagtttgcctctctctttttttcccccaaattattcttcgcctgattttcctcgcggagccctgcgctcccgacacccccgcccgcctcccctcctcctctccccccgcccgcgggccccccaaagtcccggccgggccgagggtcggcggccgccggcgggccgggcccgcgcacagcgcccgcatgtacaacatgatggagacggagctgaagccgccgggcccgcagcaaacttcggggggcggcggcggcaactccaccgcggcggcggccggcggcaaccagaaaaacagcccggaccgcgtcaagcggcccatgaatgccttcatggtgtggtcccgcgggcagcggcgcaagatggcccaggagaaccccaagatgcacaactcggagatcagcaagcgcctgggcgccgagtggaaacttttgtcggagacggagaagcggccgttcatcgacgaggctaagcggctgcgagcgctgcacatgaaggagcacccggattataaataccggccccggcggaaaaccaagacgctcatgaagaaggataagtacacgctgcccggcgggctgctggcccccggcggcaatagcatggcgagcggggtcggggtgggcgccggcctgggcgcgggcgtgaaccagcgcatggacagttacgcgcacatgaacggctggagcaacggcagctacagcatgatgcaggaccagctgggctacccgcagcacccgggcctcaatgcgcacggcgcagcgcagatgcagcccatgcaccgctacgacgtgagcgccctgcagtacaactccatgaccagctcgcagacctacatgaacggctcgcccacctacagcatgtcctactcgcagcagggcacccctggcatggctcttggctccatgggttcggtggtcaagtccgaggccagctccagcccccctgtggttacctcttcctcccactccagggcgccctgccaggccggggacctccgggacatgatcagcatgtatctccccggcgccgaggtgccggaacccgccgcccccagcagacttcacatgtcccagcactaccagagcggcccggtgcccggcacggccattaacggcacactgcccctctcacacatgtgagggccggacagcgaactggaggggggagaaattttcaaagaaaaacgagggaaatgggaggggtgcaaaagaggagagtaagaaacagcatggagaaaacccggtacgctcaaaaagaaaaaggaaaaaaaaaaatcccatcacccacagcaaatgacagctgcaaaagagaacaccaatcccatccacactcacgcaaaaaccgcgatgccgacaagaaaacttttatgagagagatcctggacttctttttgggggactatttttgtacagagaaaacctggggagggtggggagggcgggggaatggaccttgtatagatctggaggaaagaaagctacgaaaaactttttaaaagttctagtggtacggtaggagctttgcaggaagtttgcaaaagtctttaccaataatatttagagctagtctccaagcgacgaaaaaaatgttttaatatttgcaagcaacttttgtacagtatttatcgagataaacatggcaatcaaaatgtccattgtttataagctgagaatttgccaatatttttcaaggagaggcttcttgctgaattttgattctgcagctgaaatttaggacagttgcaaacgtgaaaagaagaaaattattcaaatttggacattttaattgtttaaaaattgtacaaaaggaaaaaattagaataagtactggcgaaccatctctgtggtcttgtttaaaaagggcaaaagttttagactgtactaaattttataacttactgttaaaagcaaaaatggccatgcaggttgacaccgttggtaatttataatagcttttgttcgatcccaactttccattttgttcagataaaaaaaaccatgaaattactgtgtttgaaatattttcttatggtttgtaatatttctgtaaatttattgtgatattttaaggttttcccccctttattttccgtagttgtattttaaaagattcggctctgtattatttgaatcagtctgccgagaatccatgtatatatttgaactaatatcatccttataacaggtacattttcaacttaagtttttactccattatgcacagtttgagataaataaatttttgaaatatggacactgaaaaaaaaaaaaaaaaaacctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggaaccaaaatcaacgggactttccaaaatgtcgtaacaactccgccccattgacgcaaatgggcggtaggcgtgtacggtgggaggtctatataagcagagctctccctatcagtgatagagatctccctatcagtgatagagatcgtcgacgagctcgtttagtgaaccgtcagatcgcctggagacgccatccacgctgttttgacctccatagaagacaccgggaccgatccagcctccggactctagcgtttaaacttaagcttaccatggttgtcatgggggaggtggtggcgcttggtggccactggcggccgaggtagaggcagtggcgcttgagttggtcgggggcagcggcagatttgaggcttaagcaacttcttccggggaagagtgccagtgcagccactgttacaattcaagatcttgatctatatccatagattggaatattggtgggccagcaatcctcagacgcctcacttaggacaaatgaggaaactgaggcttggtgaagttacgaaacttgtccaaaatcacacaacttgtaaagggcacagccaagattcagagccaggctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctgaaaggaagttcttcaaaggcttctttggaaaaactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagctgaaacagataagatagtcgttggttcatcagttgcccctggcaacactgccccatccccatcctctcccacctctcctacttctgatgccacgacctctctggagatgaacaatcctcatgccatcccacgccggcatgctccaattgaacagcttgctcgccaaggctctttccgaggttttcctgctcttagccagaagatgtcaccctttaaacgccaactatccctacgcatcaatgagttgccttccactatgcagaggaagactgatttccccattaaaaatgcagtgccagaagtagaaggggaggcagagagcatcagctccctgtgctcacagatcaccaatgccttcagcacacctgaggaccccttctcatctgctccgatgaccaaaccagtgacagtggtggcaccacaatctcctaccttccaagctaatggcactgactcagccttccatgtgcttgctaagccagcccatactgctctagcacccgtagcaatgcctgtgcgtgaaaccaacccttgggcccatgcccctgatgctgctaacaaggaaattgcagccacatgttcggggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatcactccctcccagatggtggccaacgtatttggcactgcaggccaccctcaggctgcccatccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaagcaatcattatggctatgtatcttgtccataccagacagggagcagggggtagcggtcaaaggagcaaaacagactttgtctcctgattagtactcttttcactaatcccaaaggtcccaaggaacaagtccaggcccagagtactgtgaggggtgattttgaaagacatgggaaaaagcattcctagagaaaagctgccttgcaattaggctaaagaagtcaaggaaatgttgctttctgtactccctcttcccttacccccttacaaatctctggcaacagagaggcaaagtatctgaacaagaatctatattccaagcacatttactgaaatgtaaaacacaacaggaagcaaagcaatctccctttgtttttcaggccattcacctgcctcctgtcagtagtggcctgtattagagatcaagaagagtggtttgtgctcaggctggggaacagagaggcacgctatgctgccagaattcccaggagggcatatcagcaactgcccagcagagctatattttgggggagaagttgagcttccattttgagtaacagaataaatattatatatatcaaaagccaaaatctttatttttatgcatttagaatattttaaatagttctcagatattaagaagttgtatgagttgtaagtaatcttgccaaaggtaaaggggctagttgtaagaaattgtacataagattgatttatcattgatgcctactgaaataaaaagaggaaaggctggaagctgcagacaggatccctagcttgttttctgtcagtcattcattgtaagtagcacattgcaacaacaatcatgcttatgaccaatacagtcactaggttgtagttttttttaaataaaggaaaagcagtattgtcctggttttaaacctatgatggaattctaatgtcattattttaatggaatcaatcgaaatatgctctatagagaatatatcttttatatattgctgcagtttccttatgttaatcctttaacactaaggtaacatgacataatcataccatagaagggaacacaggttaccatattggtttgtaatatgggtcttggtgggttttgttttatcctttaaattttgttcccatgagttttgtggggatggggattctggttttattagctttgtgtgtgtcctcttcccccaaacccccttttggtgagaacatccccttgacagttgcagcctcttgacctcggataacaataagagagctcatctcatttttacttttgaacgttggccttacaatcaaatgtaagttatatatatttgtactgatgaaaatttataatctgctttaacaaaaataaatgttcatggtagaagcttttaaaaaaaaaaaaacctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggaaccaaaatcaacgggactttccaaaatgtcgtaacaactccgccccattgacgcaaatgggcggtaggcgtgtacggtgggaggtctatataagcagagctctccctatcagtgatagagatctccctatcagtgatagagatcgtcgacgagctcgtttagtgaaccgtcagatcgcctggagacgccatccacgctgttttgacctccatagaagacaccgggaccgatccagcctccggactctagcgtttaaacttaagcttaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcacctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaaggtctatatcaccgccgacaagcagaagaacggcatcaaggtgaacttcaagacccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaacctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggaaccaaaatcaacgggactttccaaaatgtcgtaacaactccgccccattgacgcaaatgggcggtaggcgtgtacggtgggaggtctatataagcagagctcgtgagtttggggacccttgattgttctttctttttcgctattgtaaaattcatgttatatggagggggcaaagttttcagggtgttgtttagaatgggaagatgtcccttgtatcaccatggaccctcatgataattttgtttctttcactttctactctgttgacaaccattgtctcctcttattttcttttcattttctgtaactttttcgttaaactttagcttgcatttgtaacgaatttttaaattcacttttgtttatttgtcagattgtaagtactttctctaatcacttttttttcaaggcaatcagggtatattatattgtacttcagcacagttttagagaacaattgttataattaaatgataaggtagaatatttctgcatataaattctggctggcgtggaaatattcttattggtagaaacaactacatcctggtcatcatcctgcctttctctttatggttacaatgatatacactgtttgagatgaggataaaatactctgagtccaaaccgggcccctctgctaaccatgttcatgccttcttctttttcctacagctcctgggcaacgtgctggttattgtgctgtctcatcattttggcaaagaattgtaatacgactcactatagggcgaattgatatgtctagattagataaaagtaaagtgattaacagcgcattagagctgcatgtctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgggctttgctcgacgccttagccattgagatgttagataggcaccatactcacttttgccctttagaaggggaaagctggcaagattttttacgtaataacgctaaaagttttagatgtgctttactaagtcatcgcgatggagcaaaagtacatttaggtacacggcctacagaaaaacagtatgaaactctcgaaaatcaattagcctttttatgccaacaaggtttttcactagagaatgcattatatgcactcagcgctgtggggcattttactttaggttgcgtattggaagatcaagagcatcaagtcgctaaagaagaaagggaaacacctactactgatagtatgccgccattattacgacaagctatcgaattatttgatcaccaaggtgcagagccagccttcttattcggccttgaattgatcatatgcggattagaaaaacaacttaaatgtgaaagtgggtccgcgtacagcggatcccgggaattcagatcttattaaagcagaacttgtttattgcagcttataatggttacaaataaagcaatagcatcacaaatttcacaaataaagcatttttttcactgcattctagttgtggtttgtccaaactcatcaatgtatcttatcatgtctggtcaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctccccatagtgactggatatgttgtgttttacagtattatgtagtctgttttttatgcaaaatctaatttaatatattgatatttatatcattttacgtttctcgttcagctttcttgtacaaagtggttgatatccagcacagtggcggccgctcgagtctagagggcccgcggttcgaaggtaagcctatccctaaccctctcctcggtctcgattctacgcgtaccggttagtaatgagtttggaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgttgacaattaatcatcggcatagtatatcggcatagtataatacgacaaggtgaggaactaaaccatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctaagcacaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 3 - DNA, 1751 bp, Artificial Sequence
  Description of Artificial Sequence: Synthetic polynucleotide
gtcgaccagtggatcctggaggcttgctgaaggctgtatgctgatcgggtgtaaactgagcttggttttggccactgactgaccaagctcattacacccgatcaggacacaaggcctgttactagcactcacatggaacaaatggcccagatcctggaggcttgctgaaggctgtatgctgataccaggcaggataaggccagttttggccactgactgactggccttactgcctggtatcaggacacaaggcctgttactagcactcacatggaacaaatggcccagatcctggaggcttgctgaaggctgtatgctgtgaccaggatgaccaatccatgttttggccactgactgacatggattgcatcctggtcacaggacacaaggcctgttactagcactcacatggaacaaatggcccagatcctggaggcttgctgaaggctgtatgctgatagcttggtccaacctgttagttttggccactgactgactaacaggtgaccaagctatcaggacacaaggcctgttactagcactcacatggaacaaatggcccagatctccccagtggaaagacgcgcaggcaaaacgcaccacgtgacggagcgtgaccgcgcgccgagcgcgcgccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttgggtttatatatcttgtggaaaggacggtgctcgcttcggcagcacgtcgtgctagggttcttgggttttctcgcaacagcaggttctgcaatgggcgcggcgtccctgaccgtgtcggctcagtcccggactttactggccgggatagtgcagcaacagcaacagctgttggacgtggtcaagagacaacaagaactgttgcgactgaccgtctggggaacgaaaaacctccaggcaagagtcactgctatagagaagtacctacaggaccaggcgcggctaaattcatggggatgtctagacctagagcggacttcggtccgctttttccccagtggaaagacgcgcaggcaaaacgcaccacgtgacggagcgtgaccgcgcgccgagcgcgcgccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttgggtttatatatcttgtggaaaggacggtgctcgcttcggcagcacgtcggtcgctctgcggagaggctggcagattgagccctgggaggttctctccagcactagcaggtagagcctgggtgttccctgctagactctcaccagtgcttggccggcactgggcagacggctccacgcttgcttgcttaaagacctcttaataaagctgctctagacctagagcggacttcggtccgcttttttacgtactcgag

SEQ ID NO: 4 - DNA, 64 bp, Artificial Sequence
  Description of Artificial Sequence: Synthetic oligonucleotide
tgctgataccaggcaggataaggccagttttggccactgactgactggccttactgcctggtat

SEQ ID NO: 5 - DNA, 64 bp, Artificial Sequence
  Description of Artificial Sequence: Synthetic oligonucleotide
cctgataccaggcagtaaggccagtcagtcagtggccaaaactggccttatcctgcctggtatc

SEQ ID NO: 6 - DNA, 64 bp, Artificial Sequence
  Description of Artificial Sequence: Synthetic oligonucleotide
tgctgtgaccaggatgaccaatccatgttttggccactgactgacatggattgcatcctggtca

SEQ ID NO: 7 - DNA, 64 bp, Artificial Sequence
  Description of Artificial Sequence: Synthetic oligonucleotide
cctgtgaccaggatgcaatccatgtcagtcagtggccaaaacatggattggtcatcctggtcac

SEQ ID NO: 8 - DNA, 64 bp, Artificial Sequence
  Description of Artificial Sequence: Synthetic oligonucleotide
tgctgatcgggtgtaaactgagcttggttttggccactgactgaccaagctcattacacccgat

SEQ ID NO: 9 - DNA, 64 bp, Artificial Sequence
  Description of Artificial Sequence: Synthetic oligonucleotide
cctgatcgggtgtaatgagcttggtcagtcagtggccaaaaccaagctcagtttacacccgatc

SEQ ID NO: 10 - DNA, 64 bp, Artificial Sequence
  Description of Artificial Sequence: Synthetic oligonucleotide
tgctgatagcttggtccaacctgttagttttggccactgactgactaacaggtgaccaagctat

SEQ ID NO: 11 - DNA, 64 bp, Artificial Sequence
  Description of Artificial Sequence: Synthetic oligonucleotide
cctgatagcttggtcacctgttagtcagtcagtggccaaaactaacaggttggaccaagctatc

SEQ ID NO: 12 - DNA, 160 bp, Artificial Sequence
  Description of Artificial Sequence: Synthetic polynucleotide
gtcgctctgcggagaggctggcagattgagccctgggaggttctctccagcactagcaggtagagcctgggtgttccctgctagactctcaccagtgcttggccggcactgggcagacggctccacgcttgcttgcttaaagacctcttaataaagctgc

SEQ ID NO: 13 - DNA, 247 bp, Artificial Sequence
  Description of Artificial Sequence: Synthetic polynucleotide
tgctagggttcttgggttttctcgcaacagcaggttctgcaatgggcgcggcgtccctgaccgtgtcggctcagtcccggactttactggccgggatagtgcagcaacagcaacagctgttggacgtggtcaagagacaacaagaactgttgcgactgaccgtctggggaacgaaaaacctccaggcaagagtcactgctatagagaagtacctacaggaccaggcgcggctaaattcatggggatg

SEQ ID NO: 14 - DNA, 25 bp, Artificial Sequence
  Description of Combined DNA/RNA Molecule: Synthetic oligonucleotide
gugcucgcuucggcagcacgtcgac

SEQ ID NO: 15 - RNA, 26 nt, Artificial Sequence
  Description of Artificial Sequence: Synthetic olgionucleotide
ucuagagcggacuucgguccgcuuuu

SEQ ID NO: 16 - DNA, 25 bp, Artificial Sequence
  Description of Combined DNA/RNA Molecule: Synthetic oligonucleotide
gugcucgcuucggcagcacgtcgac

SEQ ID NO: 17 - RNA, 26 nt, Artificial Sequence
  Description of Artificial Sequence: Synthetic oligonucleotide
ucuagagcggacuucgguccgcuuuu

SEQ ID NO: 18 - DNA, 606 bp, Homo sapiens
atgagccggagggagggaagtctggaagacccccagactgattcctcagtctcacttcttccccacttggaggccaagatccgtcagacacacagccttgcgcacctcctcaccaaatacgctgagcagctgctccaggaatatgtgcagctccagggagaccccttcgggctgcccagcttctcgccgccgcggctgccggtggccggcctgagcgccccggctccgagccacgcggggctgccagtgcacgagcggctgcggctggacgcggcggcgctggccgcgctgcccccgctgctggacgcagtgtgtcgccgccaggccgagctgaacccgcgcgcgccgcgcctgctgcgccgcctggaggacgcggcgcgccaggcccgggccctgggcgccgccgtggaggccttgctggccgcgctgggcgccgccaaccgcgggccccgggccgagccccccgccgccaccgcctcagccgcctccgccaccggggtcttccccgccaaggtgctggggctccgcgtttgcggcctctaccgcgagtggctgagccgcaccgagggcgacctgggccagctgctgcccgggggctcggcctga

SEQ ID NO: 19 - DNA, 603 bp, Homo sapiens
atggctttcacagagcattcaccgctgacccctcaccgtcgggacctctgtagccgctctatctggctagcaaggaagattcgttcagacctgactgctcttacggaatcctatgtgaagcatcagggcctgaacaagaacatcaacctggactctgcggatgggatgccagtggcaagcactgatcagtggagtgagctgaccgaggcagagcgactccaagagaaccttcaagcttatcgtaccttccatgttttgttggccaggctcttagaagaccagcaggtgcattttaccccaaccgaaggtgacttccatcaagctatacatacccttcttctccaagtcgctgcctttgcataccagatagaggagttaatgatactcctggaatacaagatcccccgcaatgaggctgatgggatgcctattaatgttggagatggtggtctctttgagaagaagctgtggggcctaaaggtgctgcaggagctttcacagtggacagtaaggtccatccatgaccttcgtttcatttcttctcatcagactgggatcccagcacgtgggagccattatattgctaacaacaagaaaatgtag

SEQ ID NO: 20 - DNA, 990 bp, Homo sapiens
atgttgacgttgcagacttggctagtgcaagccttgtttattttcctcaccactgaatctacaggtgaacttctagatccatgtggttatatcagtcctgaatctccagttgtacaacttcattctaatttcactgcagtttgtgtgctaaaggaaaaatgtatggattattttcatgtaaatgctaattacattgtctggaaaacaaaccattttactattcctaaggagcaatatactatcataaacagaacagcatccagtgtcacctttacagatatagcttcattaaatattcagctcacttgcaacattcttacattcggacagcttgaacagaatgtttatggaatcacaataatttcaggcttgcctccagaaaaacctaaaaatttgagttgcattgtgaacgaggggaagaaaatgaggtgtgagtgggatggtggaagggaaacacacttggagacaaacttcactttaaaatctgaatgggcaacacacaagtttgctgattgcaaagcaaaacgtgacacccccacctcatgcactgttgattattctactgtgtattttgtcaacattgaagtctgggtagaagcagagaatgcccttgggaaggttacatcagatcatatcaattttgatcctgtatataaagtgaagcccaatccgccacataatttatcagtgatcaactcagaggaactgtctagtatcttaaaattgacatggaccaacccaagtattaagagtgttataatactaaaatataacattcaatataggaccaaagatgcctcaacttggagccagattcctcctgaagacacagcatccacccgatcttcattcactgtccaagaccttaaaccttttacagaatatgtgtttaggattcgctgtatgaaggaagatggtaagggatactggagtgactggagtgaagaagcaagtgggatcacctatgaagataacattgcctccttttga

SEQ ID NO: 21 - DNA, 639 bp, Homo sapiens
atgaactccttctccacaagcgccttcggtccagttgccttctccctggggctgctcctggtgttgcctgctgccttccctgccccagtacccccaggagaagattccaaagatgtagccgccccacacagacagccactcacctcttcagaacgaattgacaaacaaattcggtacatcctcgacggcatctcagccctgagaaaggagacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctagagtacctccagaacagatttgagagtagtgaggaacaagccagagctgtgcagatgagtacaaaagtcctgatccagttcctgcagaaaaaggcaaagaatctagatgcaataaccacccctgacccaaccacaaatgccagcctgctgacgaagctgcaggcacagaaccagtggctgcaggacatgacaactcatctcattctgcgcagctttaaggagttcctgcagtccagcctgagggctcttcggcaaatgtag

SEQ ID NO: 22 - DNA, 756 bp, Homo sapiens
atggctatgagttcttttttgatcaactcaaactatgtcgaccccaagttccctccatgcgaggaatattcacagagcgattacctacccagcgaccactcgcccgggtactacgccggcggccagaggcgagagagcagcttccagccggaggcgggcttcgggcggcgcgcggcgtgcaccgtgcagcgctacgcggcctgccgggaccctgggcccccgccgcctccgccaccacccccgccgcccccgccaccgcccggtctgtcccctcgggctcctgcgccgccacccgccggggccctcctcccggagcccggccagcgctgcgaggcggtcagcagcagccccccgccgcctccctgcgcccagaaccccctgcaccccagcccgtcccactccgcgtgcaaagagcccgtcgtctacccctggatgcgcaaagttcacgtgagcacggtaaaccccaattacgccggcggggagcccaagcgctctcggaccgcctacacgcgccagcaggtcttggagctggagaaggaatttcactacaaccgctacctgacacggcgccggagggtggagatcgcccacgcgctctgcctctccgagcgccagatcaagatctggttccagaaccggcgcatgaagtggaaaaaagaccacaagttgcccaacaccaagatccgctcgggtggtgcggcaggctcagccggagggccccctggccggcccaatggaggcccccgcgcgctctag

SEQ ID NO: 23 - DNA, 1407 bp, Homo sapiens
atgctggccgtcggctgcgcgctgctggctgccctgctggccgcgccgggagcggcgctggccccaaggcgctgccctgcgcaggaggtggcgagaggcgtgctgaccagtctgccaggagacagcgtgactctgacctgcccgggggtagagccggaagacaatgccactgttcactgggtgctcaggaagccggctgcaggctcccaccccagcagatgggctggcatgggaaggaggctgctgctgaggtcggtgcagctccacgactctggaaactattcatgctaccgggccggccgcccagctgggactgtgcacttgctggtggatgttccccccgaggagccccagctctcctgcttccggaagagccccctcagcaatgttgtttgtgagtggggtcctcggagcaccccatccctgacgacaaaggctgtgctcttggtgaggaagtttcagaacagtccggccgaagacttccaggagccgtgccagtattcccaggagtcccagaagttctcctgccagttagcagtcccggagggagacagctctttctacatagtgtccatgtgcgtcgccagtagtgtcgggagcaagttcagcaaaactcaaacctttcagggttgtggaatcttgcagcctgatccgcctgccaacatcacagtcactgccgtggccagaaacccccgctggctcagtgtcacctggcaagacccccactcctggaactcatctttctacagactacggtttgagctcagatatcgggctgaacggtcaaagacattcacaacatggatggtcaaggacctccagcatcactgtgtcatccacgacgcctggagcggcctgaggcacgtggtgcagcttcgtgcccaggaggagttcgggcaaggcgagtggagcgagtggagcccggaggccatgggcacgccttggacagaatccaggagtcctccagctgagaacgaggtgtccacccccatgcaggcacttactactaataaagacgatgataatattctcttcagagattctgcaaatgcgacaagcctcccagtgcaagattcttcttcagtaccactgcccacattcctggttgctggagggagcctggccttcggaacgctcctctgcattgccattgttctgaggttcaagaagacgtggaagctgcgggctctgaaggaaggcaagacaagcatgcatccgccgtactctttggggcagctggtcccggagaggcctcgacccaccccagtgcttgttcctctcatctccccaccggtgtcccccagcagcctggggtctgacaatacctcgagccacaaccgaccagatgccagggacccacggagcccttatgacatcagcaatacagactacttcttccccagatag

SEQ ID NO: 24 - DNA, 600 bp, Rattus norvegicus
atgaactgtgtttgtcgcctggtcctggtggtgctgagcctctggccagatagagtcgttgcccctgggccaccagctggctcccctcgagtgtcttcagaccctcgtgcagatctggatagcgctgtcctcttgaccaggtccctcctggcagacacacggcaactagctgcacagatgagagacaaattcccagctgatggagaccacaatctggactccctacctaccttggccatgagcgctgggacactgggatctttgcagcttcctggagtgctgacaaggcttcgagtagacttaatgtcctacttccgacatgtacagtggttgcgccgggcagctggtccttccctaaagactctggagccagagctgggtgccctgcaagcccgactggaacggctacttcgtcgcttacagctcttgatgtctcgcctagccttgccccaggcagccccggaccaacctgcggtccctctgggccctcctgcctcggcctggggaagcatccgggcagctcatgccatcctaggagggctgcacctgaccttggactgggccgtgcggggcctgctgttgttaaagactcggctgtaa

SEQ ID NO: 25 - DNA, 609 bp, Homo sapiens
atgaaggtcttggcggcaggagttgtgcccctgctgttggttctgcactggaaacatggggcggggagccccctccccatcacccctgtcaacgccacctgtgccatacgccacccatgtcacaacaacctcatgaaccagatcaggagccaactggcacagctcaatggcagtgccaatgccctctttattctctattacacagcccagggggagccgttccccaacaacctggacaagctatgtggccccaacgtgacggacttcccgcccttccacgccaacggcacggagaaggccaagctggtggagctgtaccgcatagtcgtgtaccttggcacctccctgggcaacatcacccgggaccagaagatcctcaaccccagtgccctcagcctccacagcaagctcaacgccaccgccgacatcctgcgaggcctccttagcaacgtgctgtgccgcctgtgcagcaagtaccacgtgggccatgtggacgtgacctacggccctgacacctcgggtaaggatgtcttccagaagaagaagctgggctgtcaactcctggggaagtataagcagatcatcgccgtgttggcccaggccttctag

SEQ ID NO: 26 - DNA, 3294 bp, Homo sapiens
atgatggatatttacgtatgtttgaaacgaccatcctggatggtggacaataaaagaatgaggactgcttcaaatttccagtggctgttatcaacatttattcttctatatctaatgaatcaagtaaatagccagaaaaagggggctcctcatgatttgaagtgtgtaactaacaatttgcaagtgtggaactgttcttggaaagcaccctctggaacaggccgtggtactgattatgaagtttgcattgaaaacaggtcccgttcttgttatcagttggagaaaaccagtattaaaattccagctctttcacatggtgattatgaaataacaataaattctctacatgattttggaagttctacaagtaaattcacactaaatgaacaaaacgtttccttaattccagatactccagagatcttgaatttgtctgctgatttctcaacctctacattatacctaaagtggaacgacaggggttcagtttttccacaccgctcaaatgttatctgggaaattaaagttctacgtaaagagagtatggagctcgtaaaattagtgacccacaacacaactctgaatggcaaagatacacttcatcactggagttgggcctcagatatgcccttggaatgtgccattcattttgtggaaattagatgctacattgacaatcttcatttttctggtctcgaagagtggagtgactggagccctgtgaagaacatttcttggatacctgattctcagactaaggtttttcctcaagataaagtgatacttgtaggctcagacataacattttgttgtgtgagtcaagaaaaagtgttatcagcactgattggccatacaaactgccccttgatccatcttgatggggaaaatgttgcaatcaagattcgtaatatttctgtttctgcaagtagtggaacaaatgtagtttttacaaccgaagataacatatttggaaccgttatttttgctggatatccaccagatactcctcaacaactgaattgtgagacacatgatttaaaagaaattatatgtagttggaatccaggaagggtgacagcgttggtgggcccacgtgctacaagctacactttagttgaaagtttttcaggaaaatatgttagacttaaaagagctgaagcacctacaaacgaaagctatcaattattatttcaaatgcttccaaatcaagaaatatataattttactttgaatgctcacaatccgctgggtcgatcacaatcaacaattttagttaatataactgaaaaagtttatccccatactcctacttcattcaaagtgaaggatattaattcaacagctgttaaactttcttggcatttaccaggcaactttgcaaagattaattttttatgtgaaattgaaattaagaaatctaattcagtacaagagcagcggaatgtcacaatcaaaggagtagaaaattcaagttatcttgttgctctggacaagttaaatccatacactctatatacttttcggattcgttgttctactgaaactttctggaaatggagcaaatggagcaataaaaaacaacatttaacaacagaagccagtccttcaaaggggcctgatacttggagagagtggagttctgatggaaaaaatttaataatctattggaagcctttacccattaatgaagctaatggaaaaatactttcctacaatgtatcgtgttcatcagatgaggaaacacagtccctttctgaaatccctgatcctcagcacaaagcagagatacgacttgataagaatgactacatcatcagcgtagtggctaaaaattctgtgggctcatcaccaccttccaaaatagcgagtatggaaattccaaatgatgatctcaaaatagaacaagttgttgggatgggaaaggggattctcctcacctggcattacgaccccaacatgacttgcgactacgtcattaagtggtgtaactcgtctcggtcggaaccatgccttatggactggagaaaagttccctcaaacagcactgaaactgtaatagaatctgatgagtttcgaccaggtataagatataattttttcctgtatggatgcagaaatcaaggatatcaattattacgctccatgattggatatatagaagaattggctcccattgttgcaccaaattttactgttgaggatacttctgcagattcgatattagtaaaatgggaagacattcctgtggaagaacttagaggctttttaagaggatatttgttttactttggaaaaggagaaagagacacatctaagatgagggttttagaatcaggtcgttctgacataaaagttaagaatattactgacatatcccagaagacactgagaattgctgatcttcaaggtaaaacaagttaccacctggtcttgcgagcctatacagatggtggagtgggcccggagaagagtatgtatgtggtgacaaaggaaaattctgtgggattaattattgccattctcatcccagtggcagtggctgtcattgttggagtggtgacaagtatcctttgctatcggaaacgagaatggattaaagaaaccttctaccctgatattccaaatccagaaaactgtaaagcattacagtttcaaaagagtgtctgtgagggaagcagtgctcttaaaacattggaaatgaatccttgtaccccaaataatgttgaggttctggaaactcgatcagcatttcctaaaatagaagatacagaaataatttccccagtagctgagcgtcctgaagatcgctctgatgcagagcctgaaaaccatgtggttgtgtcctattgtccacccatcattgaggaagaaataccaaacccagccgcagatgaagctggagggactgcacaggttatttacattgatgttcagtcgatgtatcagcctcaagcaaaaccagaagaagaacaagaaaatgaccctgtaggaggggcaggctataagccacagatgcacctccccattaattctactgtggaagatatagctgcagaagaggacttagataaaactgcgggttacagacctcaggccaatgtaaatacatggaatttagtgtctccagactctcctagatccatagacagcaacagtgagattgtctcatttggaagtccatgctccattaattcccgacaatttttgattcctcctaaagatgaagactctcctaaatctaatggaggagggtggtcctttacaaacttttttcagaacaaaccaaacgattaa

SEQ ID NO: 27 - DNA, 2310 bp, Homo sapiens
atggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggcgctgccccatacctgaagaccaagtttatctgtgtgacaccaacgacctgcagcaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatgtga

SEQ ID NO: 28 - DNA, 1956 bp, Homo sapiens
atgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctgaaaggaagttcttcaaaggcttctttggaaaaactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagctgaaacagataagatagtcgttggttcatcagttgcccctggcaacactgccccatccccatcctctcccacctctcctacttctgatgccacgacctctctggagatgaacaatcctcatgccatcccacgccggcatgctccaattgaacagcttgctcgccaaggctctttccgaggttttcctgctcttagccagaagatgtcaccctttaaacgccaactatccctacgcatcaatgagttgccttccactatgcagaggaagactgatttccccattaaaaatgcagtgccagaagtagaaggggaggcagagagcatcagctccctgtgctcacagatcaccaatgccttcagcacacctgaggaccccttctcatctgctccgatgaccaaaccagtgacagtggtggcaccacaatctcctaccttccaagctaatggcactgactcagccttccatgtgcttgctaagccagcccatactgctctagcacccgtagcaatgcctgtgcgtgaaaccaacccttgggcccatgcccctgatgctgctaacaaggaaattgcagccacatgttcggggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatcactccctcccagatggtggccaacgtatttggcactgcaggccaccctcaggctgcccatccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaa

SEQ ID NO: 29 - DNA, 1812 bp, Homo sapiens
atgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctgaaaggaagttcttcaaaggcttctttggaaaaactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagctgaaacagataagatagtcgttggttcatcagttgcccctggcaacactgccccatccccatcctctcccacctctcctacttctgatgccacgacctctctggagatgaacaatcctcatgccatcccacgccggcatgctccaattgaacagcttgctcgccaaggctctttccgaggttttcctgctcttagccagaagatgtcaccctttaaacgccaactatccctacgcatcaatgagttgccttccactatgcagaggaagactgatttccccattaaaaatgcagtgccagaagtagaaggggaggcagagagcatcagctccctgtgctcacagatcaccaatgccttcagcacacctgaggaccccttctcatctgctccgatgaccaaaccagtgacagtggtggcaccacaatctcctaccttccaagggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatcactccctcccagatggtggccaacgtatttggcactgcaggccaccctcaggctgcccatccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaa

SEQ ID NO: 30 - DNA, 1923 bp, Homo sapiens
atgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagctgaaacagataagatagtcgttggttcatcagttgcccctggcaacactgccccatccccatcctctcccacctctcctacttctgatgccacgacctctctggagatgaacaatcctcatgccatcccacgccggcatgctccaattgaacagcttgctcgccaaggctctttccgaggttttcctgctcttagccagaagatgtcaccctttaaacgccaactatccctacgcatcaatgagttgccttccactatgcagaggaagactgatttccccattaaaaatgcagtgccagaagtagaaggggaggcagagagcatcagctccctgtgctcacagatcaccaatgccttcagcacacctgaggaccccttctcatctgctccgatgaccaaaccagtgacagtggtggcaccacaatctcctaccttccaagctaatggcactgactcagccttccatgtgcttgctaagccagcccatactgctctagcacccgtagcaatgcctgtgcgtgaaaccaacccttgggcccatgcccctgatgctgctaacaaggaaattgcagccacatgttcggggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatcactccctcccagatggtggccaacgtatttggcactgcaggccaccctcaggctgcccatccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaa

SEQ ID NO: 31 - DNA, 1779 bp, Homo sapiens
atgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagctgaaacagataagatagtcgttggttcatcagttgcccctggcaacactgccccatccccatcctctcccacctctcctacttctgatgccacgacctctctggagatgaacaatcctcatgccatcccacgccggcatgctccaattgaacagcttgctcgccaaggctctttccgaggttttcctgctcttagccagaagatgtcaccctttaaacgccaactatccctacgcatcaatgagttgccttccactatgcagaggaagactgatttccccattaaaaatgcagtgccagaagtagaaggggaggcagagagcatcagctccctgtgctcacagatcaccaatgccttcagcacacctgaggaccccttctcatctgctccgatgaccaaaccagtgacagtggtggcaccacaatctcctaccttccaagggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatcactccctcccagatggtggccaacgtatttggcactgcaggccaccctcaggctgcccatccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaa

SEQ ID NO: 32 - DNA, 1830 bp, Mus musculus
atgtcccgcagcgcggcggccagcggcggaccccggaggcctgagcggcacctgcccccagccccctgtggggccccggggcccccagaaacctgcaggacggagccagacggggcgggcaccatgaacaagttacggcagagcctgcggcggaggaagccagcctacgtgcccgaggcgtcgcgcccgcaccagtggcaggcagacgaggacgcggtgcggaagggcacgtgcagcttcccggtcaggtacctgggtcacgtggaggtagaggagtcccggggaatgcacgtgtgtgaagatgcggtgaagaagctgaaggcgatgggccgaaagtccgtgaagtctgtcctgtgggtgtcagccgatgggctccgagtggtggacgacaaaaccaaggatcttctggtcgaccagaccatcgaaaaggtctccttttgtgctcctgaccgcaacctggacaaggctttctcctatatctgtcgtgacgggactacccgccgctggatctgccactgttttctggcactgaaggactccggcgagaggctgagccacgctgtgggctgtgcttttgccgcctgcctggagcgaaaacagcgacgggagaaggaatgtggggtcacggccgccttcgatgccagccgcaccagcttcgcccgcgagggctccttccgcctgtctgggggtgggcggcctgctgagcgagaggccccggacaagaagaaagcagaggcagcagctgcccccactgtggctcctggccctgcccagcctgggcacgtgtccccgacaccagccaccacatcccctggtgagaagggtgaggcaggcacccctgtggctgcaggcaccactgcggccgccatcccccggcgccatgcacccctggagcagctggttcgccagggctccttccgtgggttcccagcactcagccagaagaactcgcctttcaaacggcagctgagcctacggctgaatgagctgccatccacgctgcagcgccgcactgacttccaggtgaagggcacagtgcctgagatggagcctcctggtgccggcgacagtgacagcatcaacgctctgtgcacacagatcagttcatcttttgccagtgctggagcgccagcaccagggccaccacctgccacaacagggacttctgcctggggtgagccctccgtgccccctgcagctgccttccagcctgggcacaagcggacaccttcagaggctgagcgatggctggaggaggtgtcacaggtggccaaggcccagcagcagcagcagcagcaacagcaacagcagcagcagcagcagcagcaacagcagcaagcagcctcagtggccccagtgcccaccatgcctcctgccctgcagcctttccccgcccccgtggggccctttgacgctgcacctgcccaagtggccgtgttcctgccacccccacacatgcagcccccttttgtgcccgcctacccgggcttgggctacccaccgatgccccgggtgcccgtggtgggcatcacaccctcacagatggtggcaaacgccttctgctcagccgcccagctccagcctcagcctgccactctgcttgggaaagctggggccttcccgccccctgccatacccagtgcccctgggagccaggcccgccctcgccccaatggggccccctggccccctgagccagcgcctgccccagctccagagttggacccctttgaggcccagtgggcggcattagaaggcaaagccactgtagagaaaccctccaaccccttttctggcgacctgcaaaagacattcgagattgaactgtag

SEQ ID NO: 33 - DNA, 918 bp, Homo sapiens
atgagtgtggatccagcttgtccccaaagcttgccttgctttgaagcatccgactgtaaagaatcttcacctatgcctgtgatttgtgggcctgaagaaaactatccatccttgcaaatgtcttctgctgagatgcctcacacggagactgtctctcctcttccttcctccatggatctgcttattcaggacagccctgattcttccaccagtcccaaaggcaaacaacccacttctgcagagaagagtgtcgcaaaaaaggaagacaaggtcccggtcaagaaacagaagaccagaactgtgttctcttccacccagctgtgtgtactcaatgatagatttcagagacagaaatacctcagcctccagcagatgcaagaactctccaacatcctgaacctcagctacaaacaggtgaagacctggttccagaaccagagaatgaaatctaagaggtggcagaaaaacaactggccgaagaatagcaatggtgtgacgcagaaggcctcagcacctacctaccccagcctttactcttcctaccaccagggatgcctggtgaacccgactgggaaccttccaatgtggagcaaccagacctggaacaattcaacctggagcaaccagacccagaacatccagtcctggagcaaccactcctggaacactcagacctggtgcacccaatcctggaacaatcaggcctggaacagtcccttctataactgtggagaggaatctctgcagtcctgcatgcagttccagccaaattctcctgccagtgacttggaggctgccttggaagctgctggggaaggccttaatgtaatacagcagaccactaggtattttagtactccacaaaccatggatttattcctaaactactccatgaacatgcaacctgaagacgtgtga

SEQ ID NO: 34 - DNA, 759 bp, Homo sapiens
atgggggtactgctcacacagaggacgctgctcagtctggtccttgcactcctgtttccaagcatggcgagcatggcggctataggcagctgctcgaaagagtaccgcgtgctccttggccagctccagaagcagacagatctcatgcaggacaccagcagactcctggacccctatatacgtatccaaggcctggatgttcctaaactgagagagcactgcagggagcgccccggggccttccccagtgaggagaccctgagggggctgggcaggcggggcttcctgcagaccctcaatgccacactgggctgcgtcctgcacagactggccgacttagagcagcgcctccccaaggcccaggatttggagaggtctgggctgaacatcgaggacttggagaagctgcagatggcgaggccgaacatcctcgggctcaggaacaacatctactgcatggcccagctgctggacaactcagacacggctgagcccacgaaggctggccggggggcctctcagccgcccacccccacccctgcctcggatgcttttcagcgcaagctggagggctgcaggttcctgcatggctaccatcgcttcatgcactcagtggggcgggtcttcagcaagtggggggagagcccgaaccggagccggagacacagcccccaccaggccctgaggaagggggtgcgcaggaccagaccctccaggaaaggcaagagactcatgaccaggggacagctgccccggtag

SEQ ID NO: 35 - DNA, 2940 bp, Homo sapiens
atggctctatttgcagtctttcagacaacattcttcttaacattgctgtccttgaggacttaccagagtgaagtcttggctgaacgtttaccattgactcctgtatcacttaaagtttccaccaattctacgcgtcagagtttgcacttacaatggactgtccacaaccttccttatcatcaggaattgaaaatggtatttcagatccagatcagtaggattgaaacatccaatgtcatctgggtggggaattacagcaccactgtgaagtggaaccaggttctgcattggagctgggaatctgagctccctttggaatgtgccacacactttgtaagaataaagagtttggtggacgatgccaagttccctgagccaaatttctggagcaactggagttcctgggaggaagtcagtgtacaagattctactggacaggatatattgttcgttttccctaaagataagctggtggaagaaggcaccaatgttaccatttgttacgtttctaggaacattcaaaataatgtatcctgttatttggaagggaaacagattcatggagaacaacttgatccacatgtaactgcattcaacttgaatagtgtgcctttcattaggaataaagggacaaatatctattgtgaggcaagtcaaggaaatgtcagtgaaggcatgaaaggcatcgttctttttgtctcaaaagtacttgaggagcccaaggacttttcttgtgaaaccgaggacttcaagactttgcactgtacttgggatcctgggacggacactgccttggggtggtctaaacaaccttcccaaagctacactttatttgaatcattttctggggaaaagaaactttgtacacacaaaaactggtgtaattggcaaataactcaagactcacaagaaacctataacttcacactcatagctgaaaattacttaaggaagagaagtgtcaatatcctttttaacctgactcatcgagtttatttaatgaatccttttagtgtcaactttgaaaatgtaaatgccacaaatgccatcatgacctggaaggtgcactccataaggaataatttcacatatttgtgtcagattgaactccatggtgaaggaaaaatgatgcaatacaatgtttccatcaaggtgaacggtgagtacttcttaagtgaactggaacctgccacagagtacatggcgcgagtacggtgtgctgatgccagccacttctggaaatggagtgaatggagtggtcagaacttcaccacacttgaagctgctccctcagaggcccctgatgtctggagaattgtgagcttggagccaggaaatcatactgtgaccttattctggaagccattatcaaaactgcatgccaatggaaagatcctgttctataatgtagttgtagaaaacctagacaaaccatccagttcagagctccattccattccagcaccagccaacagcacaaaactaatccttgacaggtgttcctaccaaatctgcgtcatagccaacaacagtgtgggtgcttctcctgcttctgtaatagtcatctctgcagaccccgaaaacaaagaggttgaggaagaaagaattgcaggcacagagggtggattctctctgtcttggaaaccccaacctggagatgttataggctatgttgtggactggtgtgaccatacccaggatgtgctcggtgatttccagtggaagaatgtaggtcccaataccacaagcacagtcattagcacagatgcttttaggccaggagttcgatatgacttcagaatttatgggttatctacaaaaaggattgcttgtttattagagaaaaaaacaggatactctcaggaacttgctccttcagacaaccctcacgtgctggtggatacattgacatcccactccttcactctgagttggaaagattactctactgaatctcaacctggttttatacaagggtaccatgtctatctgaaatccaaggcgaggcagtgccacccacgatttgaaaaggcagttctttcagatggttcagaatgttgcaaatacaaaattgacaacccggaagaaaaggcattgattgtggacaacctaaagccagaatccttctatgagtttttcatcactccattcactagtgctggtgaaggccccagtgctacgttcacgaaggtcacgactccggatgaacactcctcgatgctgattcatatcctactgcccatggttttctgcgtcttgctcatcatggtcatgtgctacttgaaaagtcagtggatcaaggagacctgttatcctgacatccctgacccttacaagagcagcatcctgtcattaataaaattcaaggagaaccctcacctaataataatgaatgtcagtgactgtatcccagatgctattgaagttgtaagcaagccagaagggacaaagatacagttcctaggcactaggaagtcactcacagaaaccgagttgactaagcctaactacctttatctccttccaacagaaaagaatcactctggccctggcccctgcatctgttttgagaacttgacctataaccaggcagcttctgactctggctcttgtggccatgttccagtatccccaaaagccccaagtatgctgggactaatgacctcacctgaaaatgtactaaaggcactagaaaaaaactacatgaactccctgggagaaatcccagctggagaaacaagtttgaattatgtgtcccagttggcttcacccatgtttggagacaaggacagtctcccaacaaacccagtagaggcaccacactgttcagagtataaaatgcaaatggcagtctccctgcgtcttgccttgcctcccccgaccgagaatagcagcctctcctcaattacccttttagatccaggtgaacactactgctaa

SEQ ID NO: 36 - DNA, 798 bp, Homo sapiens
atgcacttctacagactattccttggggccacacgtaggttcttgaatcccgaatggaaaggggagattgataactggtgtgtttatgttcttacaagtcttctgccttttaaaatccagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctccgtcaccactctgggctctcccatgcattcaaactga

SEQ ID NO: 37 - DNA, 1083 bp, Homo sapiens
atggcgggacacctggcttcggatttcgccttctcgccccctccaggtggtggaggtgatgggccaggggggccggagccgggctgggttgatcctcggacctggctaagcttccaaggccctcctggagggccaggaatcgggccgggggttgggccaggctctgaggtgtgggggattcccccatgccccccgccgtatgagttctgtggggggatggcgtactgtgggccccaggttggagtggggctagtgccccaaggcggcttggagacctctcagcctgagggcgaagcaggagtcggggtggagagcaactccgatggggcctccccggagccctgcaccgtcacccctggtgccgtgaagctggagaaggagaagctggagcaaaacccggaggagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctccgtcaccactctgggctctcccatgcattcaaactga

SEQ ID NO: 38 - DNA, 953 bp, Homo sapiens
tgtacaacatgatggagacggagctgaagccgccgggcccgcagcaaacttcggggggcggcggcggcaactccaccgcggcggcggccggcggcaaccagaaaaacagcccggaccgcgtcaagcggcccatgaatgccttcatggtgtggtcccgcgggcagcggcgcaagatggcccaggagaaccccaagatgcacaactcggagatcagcaagcgcctgggcgccgagtggaaacttttgtcggagacggagaagcggccgttcatcgacgaggctaagcggctgcgagcgctgcacatgaaggagcacccggattataaataccggccccggcggaaaaccaagacgctcatgaagaaggataagtacacgctgcccggcgggctgctggcccccggcggcaatagcatggcgagcggggtcggggtgggcgccggcctgggcgcgggcgtgaaccagcgcatggacagttacgcgcacatgaacggctggagcaacggcagctacagcatgatgcaggaccagctgggctacccgcagcacccgggcctcaatgcgcacggcgcagcgcagatgcagcccatgcaccgctacgacgtgagcgccctgcagtacaactccatgaccagctcgcagacctacatgaacggctcgcccacctacagcatgtcctactcgcagcagggcacccctggcatggctcttggctccatgggttcggtggtcaagtccgaggccagctccagcccccctgtggttacctcttcctcccactccagggcgccctgccaggccggggacctccgggacatgatcagcatgtatctccccggcgccgaggtgccggaacccgccgcccccagcagacttcacatgtcccagcactaccagagcggcccggtgcccggcacggccattaacggcacactgcccctctcacacatgtga

SEQ ID NO: 39 - DNA, 621 bp, Homo sapiens
atgtcggggcccgggacggccgcggtagcgctgctcccggcggtcctgctggccttgctggcgccctgggcgggccgagggggcgccgccgcacccactgcacccaacggcacgctggaggccgagctggagcgccgctgggagagcctggtggcgctctcgttggcgcgcctgccggtggcagcgcagcccaaggaggcggccgtccagagcggcgccggcgactacctgctgggcatcaagcggctgcggcggctctactgcaacgtgggcatcggcttccacctccaggcgctccccgacggccgcatcggcggcgcgcacgcggacacccgcgacagcctgctggagctctcgcccgtggagcggggcgtggtgagcatcttcggcgtggccagccggttcttcgtggccatgagcagcaagggcaagctctatggctcgcccttcttcaccgatgagtgcacgttcaaggagattctccttcccaacaactacaacgcctacgagtcctacaagtaccccggcatgttcatcgccctgagcaagaatgggaagaccaagaaggggaaccgagtgtcgcccaccatgaaggtcacccacttcctccccaggctgtga

SEQ ID NO: 40 - DNA, 1443 bp, Homo sapiens
atggaggtggcgccggagcagccgcgctggatggcgcacccggccgtgctgaatgcgcagcaccccgactcacaccacccgggcctggcgcacaactacatggaacccgcgcagctgctgcctccagacgaggtggacgtcttcttcaatcacctcgactcgcagggcaacccctactatgccaaccccgctcacgcgcgggcgcgcgtctcctacagccccgcgcacgcccgcctgaccggaggccagatgtgccgcccacacttgttgcacagcccgggtttgccctggctggacgggggcaaagcagccctctctgccgctgcggcccaccaccacaacccctggaccgtgagccccttctccaagacgccactgcacccctcagctgctggaggccctggaggcccactctctgtgtacccaggggctgggggtgggagcgggggaggcagcgggagctcagtggcctccctcacccctacagcagcccactctggctcccaccttttcggcttcccacccacgccacccaaagaagtgtctcctgaccctagcaccacgggggctgcgtctccagcctcatcttccgcggggggtagtgcagcccgaggagaggacaaggacggcgtcaagtaccaggtgtcactgacggagagcatgaagatggaaagtggcagtcccctgcgcccaggcctagctactatgggcacccagcctgctacacaccaccccatccccacctacccctcctatgtgccggcggctgcccacgactacagcagcggactcttccaccccggaggcttcctggggggaccggcctccagcttcacccctaagcagcgcagcaaggctcgttcctgttcagaaggccgggagtgtgtcaactgtggggccacagccacccctctctggcggcgggacggcaccggccactacctgtgcaatgcctgtggcctctaccacaagatgaatgggcagaaccgaccactcatcaagcccaagcgaagactgtcggccgccagaagagccggcacctgttgtgcaaattgtcagacgacaaccaccaccttatggcgccgaaacgccaacggggaccctgtctgcaacgcctgtggcctctactacaagctgcacaatgttaacaggccactgaccatgaagaaggaagggatccagactcggaaccggaagatgtccaacaagtccaagaagagcaagaaaggggcggagtgcttcgaggagctgtcaaagtgcatgcaggagaagtcatcccccttcagtgcagctgccctggctggacacatggcacctgtgggccacctcccgcccttcagccactccggacacatcctgcccactccgacgcccatccacccctcctccagcctctccttcggccacccccacccgtccagcatggtgaccgccatgggctag

SEQ ID NO: 41 - DNA, 1335 bp, Homo sapiens
atggaggtgacggcggaccagccgcgctgggtgagccaccaccaccccgccgtgctcaacgggcagcacccggacacgcaccacccgggcctcagccactcctacatggacgcggcgcagtacccgctgccggaggaggtggatgtgctttttaacatcgacggtcaaggcaaccacgtcccgccctactacggaaactcggtcagggccacggtgcagaggtaccctccgacccaccacgggagccaggtgtgccgcccgcctctgcttcatggatccctaccctggctggacggcggcaaagccctgggcagccaccacaccgcctccccctggaatctcagccccttctccaagacgtccatccaccacggctccccggggcccctctccgtctaccccccggcctcgtcctcctccttgtcggggggccacgccagcccgcacctcttcaccttcccgcccaccccgccgaaggacgtctccccggacccatcgctgtccaccccaggctcggccggctcggcccggcaggacgagaaagagtgcctcaagtaccaggtgcccctgcccgacagcatgaagctggagtcgtcccactcccgtggcagcatgaccgccctgggtggagcctcctcgtcgacccaccaccccatcaccacctacccgccctacgtgcccgagtacagctccggactcttcccccccagcagcctgctgggcggctcccccaccggcttcggatgcaagtccaggcccaaggcccggtccagcacagaaggcagggagtgtgtgaactgtggggcaacctcgaccccactgtggcggcgagatggcacgggacactacctgtgcaacgcctgcgggctctatcacaaaatgaacggacagaaccggcccctcattaagcccaagcgaaggctgtctgcagccaggagagcagggacgtcctgtgcgaactgtcagaccaccacaaccacactctggaggaggaatgccaatggggaccctgtctgcaatgcctgtgggctctactacaagcttcacaatattaacagacccctgactatgaagaaggaaggcatccagaccagaaaccgaaaaatgtctagcaaatccaaaaagtgcaaaaaagtgcatgactcactggaggacttccccaagaacagctcgtttaacccggccgccctctccagacacatgtcctccctgagccacatctcgcccttcagccactccagccacatgctgaccacgcccacgccgatgcacccgccatccagcctgtcctttggaccacaccacccctccagcatggtcaccgccatgggttag

SEQ ID NO: 42 - DNA, 1329 bp, Homo sapiens
atgtatcagagcttggccatggccgccaaccacgggccgccccccggtgcctacgaggcgggcggccccggcgccttcatgcacggcgcgggcgccgcgtcctcgccagtctacgtgcccacaccgcgggtgccctcctccgtgctgggcctgtcctacctccagggcggaggcgcgggctctgcgtccggaggcgcctcgggcggcagctccggtggggccgcgtctggtgcggggcccgggacccagcagggcagcccgggatggagccaggcgggagccgacggagccgcttacaccccgccgccggtgtcgccgcgcttctccttcccggggaccaccgggtccctggcggccgccgccgccgctgccgcggcccgggaagctgcggcctacagcagtggcggcggagcggcgggtgcgggcctggcgggccgcgagcagtacgggcgcgccggcttcgcgggctcctactccagcccctacccggcttacatggccgacgtgggcgcgtcctgggccgcagccgccgccgcctccgccggccccttcgacagcccggtcctgcacagcctgcccggccgggccaacccggccgcccgacaccccaatctcgatatgtttgacgacttctcagaaggcagagagtgtgtcaactgtggggctatgtccaccccgctctggaggcgagatgggacgggtcactatctgtgcaacgcctgcggcctctaccacaagatgaacggcatcaaccggccgctcatcaagcctcagcgccggctgtccgcctcccgccgagtgggcctctcctgtgccaactgccagaccaccaccaccacgctgtggcgccgcaatgcggagggcgagcctgtgtgcaatgcctgcggcctctacatgaagctccacggggtccccaggcctcttgcaatgcggaaagaggggatccaaaccagaaaacggaagcccaagaacctgaataaatctaagacaccagcagctccttcaggcagtgagagccttcctcccgccagcggtgcttccagcaactccagcaacgccaccaccagcagcagcgaggagatgcgtcccatcaagacggagcctggcctgtcatctcactacgggcacagcagctccgtgtcccagacgttctcagtcagtgcgatgtctggccatgggccctccatccaccctgtcctctcggccctgaagctctccccacaaggctatgcgtctcccgtcagccagtctccacagaccagctccaagcaggactcttggaacagcctggtcttggccgacagtcacggggacataatcactgcgtaa

SEQ ID NO: 43 - DNA, 1194 bp, Homo sapiens
atgtaccagagcctggcgctggccgcgagcccccgccaggccgcctacgccgactcgggctccttcctgcacgctccgggcgccggctctccgatgtttgtgccgccggcgcgcgtcccctcgatgctgtcctacctgtccgggtgtgagccgagcccgcagccccccgagctcgctgcgcgccccggctgggcgcagacagccaccgcggattcgtcggccttcggcccgggcagtccgcaccccccagccgcgcacccgcccggggccaccgccttccctttcgcgcacagcccctcggggcccggcagcggcggcagcgcggggggccgagacggcagtgcctaccagggcgcgctgttgcctcgagaacagttcgcggccccgcttgggcggccggtggggacctcgtactccgccacctacccggcctacgtgagccccgacgtggcccagtcctggactgccgggcccttcgatggcagcgtcctgcacggcctcccaggccgcaggcccaccttcgtgtccgacttcttggaggagttcccgggtgagggtcgtgagtgtgtcaactgcggggccctgtccacaccgctgtggcgccgagatggcaccggccactacctgtgcaatgcctgcggcctctaccacaagatgaatggcgtcaaccggccgctcgttcggcctcagaagcgcctgtcctcgtcccgccgcgccggcctctgctgcaccaactgccacacgaccaacaccacgctgtggcggcggaactcggagggggagcccgtgtgcaatgcctgcggcctctacatgaagctgcacggggtgccgcggcctctggctatgaagaaagaaagcatccagacacggaagcggaagccaaagaccatcgccaaggccaggggctcctcaggatccacaaggaatgcctcggcctccccatctgctgtcgccagcactgacagctcagcagccacttccaaagccaagcccagcctggcgtccccagtgtgccctgggcccagcatggccccccaggcctctggccaggaggatgactctcttgcccccggccacttggagttcaagttcgagcctgaggactttgccttcccctccacggccccgagcccccaggctggcctcaggggggctctgcgccaagaggcctggtgtgcgctggccttggcctag

SEQ ID NO: 44 - DNA, 1788 bp, Homo sapiens
atggccttgactgacggcggctggtgcttgccgaagcgcttcggggccgcgggtgcggacgccagcgactccagagcctttccagcgcgggagccctccacgccgccttcccccatctcttcctcgtcctcctcctgctcccggggcggagagcggggccccggcggcgccagcaactgcgggacgcctcagctcgacacggaggcggcggccggacccccggcccgctcgctgctgctcagttcctacgcttcgcatcccttcggggctccccacggaccttcggcgcctggggtcgcgggccccgggggcaacctgtcgagctgggaggacttgctgctgttcactgacctcgaccaagccgcgaccgccagcaagctgctgtggtccagccgcggcgccaagctgagccccttcgcacccgagcagccggaggagatgtaccagaccctcgccgctctctccagccagggtccggccgcctacgacggcgcgcccggcggcttcgtgcactctgcggccgcggcggcagcagccgcggcggcggccagctccccggtctacgtgcccaccacccgcgtgggttccatgctgcccggcctaccgtaccacctgcaggggtcgggcagtgggccagccaaccacgcgggcggcgcgggcgcgcaccccggctggcctcaggcctcggccgacagccctccatacggcagcggaggcggcgcggctggcggcggggccgcggggcctggcggcgctggctcagccgcggcgcacgtctcggcgcgcttcccctactctcccagcccgcccatggccaacggcgccgcgcgggagccgggaggctacgcggcggcgggcagtgggggcgcgggaggcgtgagcggcggcggcagtagcctggcggccatgggcggccgcgagccccagtacagctcgctgtcggccgcgcggccgctgaacgggacgtaccaccaccaccaccaccaccaccaccaccatccgagcccctactcgccctacgtgggggcgccactgacgcctgcctggcccgccggacccttcgagaccccggtgctgcacagcctgcagagccgcgccggagccccgctcccggtgccccggggtcccagtgcagacctgctggaggacctgtccgagagccgcgagtgcgtgaactgcggctccatccagacgccgctgtggcggcgggacggcaccggccactacctgtgcaacgcctgcgggctctacagcaagatgaacggcctcagccggcccctcatcaagccgcagaagcgcgtgccttcatcacggcggcttggattgtcctgtgccaactgtcacaccacaactaccaccttatggcgcagaaacgccgagggtgaacccgtgtgcaatgcttgtggactctacatgaaactccatggggtgcccagaccacttgctatgaaaaaagagggaattcaaaccaggaaacgaaaacctaagaacataaataaatcaaagacttgctctggtaatagcaataattccattcccatgactccaacttccacctcttctaactcagatgattgcagcaaaaatacttcccccacaacacaacctacagcctcaggggcgggtgccccggtgatgactggtgcgggagagagcaccaatcccgagaacagcgagctcaagtattcgggtcaagatgggctctacataggcgtcagtctcgcctcgccggccgaagtcacgtcctccgtgcgaccggattcctggtgcgccctggccctggcctga

SEQ ID NO: 45 - DNA, 1674 bp, Homo sapiens
atggtgtccaagctcacgtcgctccagcaagaactcctgagcgccctgctgagctccggggtcaccaaggaggtgctggttcaggccttggaggagttgctgccatccccgaacttcggggtgaagctggagacgctgcccctgtcccctggcagcggggccgagcccgacaccaagccggtcttccatactctcaccaacggccacgccaagggccgcttgtccggcgacgagggctccgaggacggcgacgactatgacacacctcccatcctcaaggagctgcaggcgctcaacaccgaggaggcggcggagcagcgggcggaggtggaccggatgctcagtgaggacccttggagggctgctaaaatgatcaagggttacatgcagcaacacaacatcccccagagggaggtggtcgatgtcaccggcctgaaccagtcgcacctctcccagcatctcaacaagggcacccctatgaagacccagaagcgtgccgctctgtacacctggtacgtcagaaagcaacgagagatcctccgacaattcaaccagacagtccagagttctggaaatatgacagacaaaagcagtcaggatcagctgctgtttctctttccagagttcagtcaacagagccatgggcctgggcagtccgatgatgcctgctctgagcccaccaacaagaagatgcgccgcaaccggttcaaatgggggcccgcgtcccagcaaatcttgtaccaggcctacgatcggcaaaagaaccccagcaaggaagagagagaggccttagtggaggaatgcaacagggcagaatgtttgcagcgaggggtgtccccctccaaagcccacggcctgggctccaacttggtcactgaggtccgtgtctacaactggtttgcaaaccgcaggaaggaggaggcattccggcaaaagctggccatggacgcctatagctccaaccagactcacagcctgaaccctctgctctcccacggctccccccaccaccagcccagctcctctcctccaaacaagctgtcaggagtgcgctacagccagcagggaaacaatgagatcacttcctcctcaacaatcagtcaccatggcaacagcgccatggtgaccagccagtcggttttacagcaagtctccccagccagcctggacccaggccacaatctcctctcacctgatggtaaaatgatctcagtctcaggaggaggtttgcccccagtcagcaccttgacgaatatccacagcctctcccaccataatccccagcaatctcaaaacctcatcatgacacccctctctggagtcatggcaattgcacaaagcctcaacacctcccaagcacagagtgtccctgtcatcaacagtgtggccggcagcctggcagccctgcagcccgtccagttctcccagcagctgcacagccctcaccagcagcccctcatgcagcagagcccaggcagccacatggcccagcagcccttcatggcagctgtgactcagctgcagaactcacacatgtacgcacacaagcaggaacccccccagtattcccacacctcccggtttccatctgcaatggtggtcacagataccagcagcatcagtacactcaccaacatgtcttcaagtaaacagtgtcctctacaagcctggtga

SEQ ID NO: 46 - DNA, 1887 bp, Rattus norvegicus
atggtttctaagttgagccagctgcagacggagctcctggctgctctgctcgagtcgggcctgagcaaagaggctctgatccaggctctgggggagcccgggccctacctgatggttggagatggtcccctggacaagggggagtcctgcggtgggactcgaggggacctgaccgagctgcccaatggcctgggggagacgcgtggctcggaagatgacacggatgacgatggggaagacttcgcgccacccattctgaaagagctggagaacctcagcccagaggaggcagcccaccagaaagccgtggtggagtcacttcttcaggaggacccatggcgcgtggcaaagatggtcaagtcgtacctgcagcaacacaacatcccccagcgggaggtggtggacactacgggtctcaaccagtcccacctgtcccagcacctcaacaagggcacccccatgaagacgcagaagcgggccgcgctgtacacctggtacgtccgcaagcagcgagaggtggctcagcaattcacccacgcggggcagggcggactgattgaagagcccacaggtgatgagctgccaaccaaaaaggggcggaggaaccggttcaagtggggccccgcatcccagcagatcctgttccaggcttacgagaggcagaagaaccccagcaaggaagagcgagagaccttggtggaggagtgcaatagggcggagtgcatccagagaggggtgtcaccatcgcaggcccaggggctaggctccaaccttgtcaccgaggtgcgtgtctacaactggtttgccaaccggcgcaaggaagaagcctttcggcataagctggccatggacacgtataacgggcctccacccgggccaggccccggccctgcgctacctgcccacagttccccgggcctgcccacaaccaccctctctcccagtaaggtccacggtgtgcggtatggacagtctgcaaccagcgaggcagctgaggtgccctccagcagcggaggtcccttagtcacagtgtctgcggccttacaccaagtgtcccccacaggcttggagcccagcagcctgctgagcaccgaggccaagctggtctcagccacggggggtcccctgcctcccgtcagcaccctgacagcactgcacagcttggagcagacgtctccaggtctcaaccagcagccgcagaaccttatcatggcctcgctgcctggggtcatgaccatcggcccaggggagcccgcctccctgggtcccacgttcactaacacgggtgcctctaccctggtcattggtctggcctccacacaggcacagagcgtgccagtcatcaacagcatggggagcagcctgaccaccctgcagccggtccagttttcccagccactgcacccttcctatcagcagcctctcatgccccctgtacagagccacgtggcccagagtcccttcatggcaaccatggcccagctgcagagcccccacgccctgtacagccacaagcctgaggtggcccagtacacgcatacaagcctgcttccgcagaccatgctgatcacagacaccaacctcagcacccttgccagcctcacgcccaccaagcaggtcttcacctcagacacagaggcctccagtgagcctgggcttcatgagccgtcgtctccagccacaaccattcacatccccagccaggacccgtcaaacatccagcacctgcagcctgctcaccggctcagcaccagtcccacagtgtcctccagcagcctggtgttgtaccagagttctgactccaacgggcacagccacctgctgccatccaaccacggtgtcatcgagacttttatctccacccagatggcctcctcctcccagtaa

SEQ ID NO: 47 - DNA, 1407 bp, Mus musculus
atgttagggactgtgaagatggaagggcatgagagcaacgactggaacagctactacgcggacacgcaggaggcctactcctctgtccctgtcagcaacatgaactccggcctgggctctatgaactccatgaacacctacatgaccatgaacaccatgaccacgagcggcaacatgaccccggcttccttcaacatgtcctacgccaacacgggcttaggggccggcctgagtcccggtgctgtggctggcatgccaggggcctctgcaggcgccatgaacagcatgactgcggcgggcgtcacggccatgggtacggcgctgagcccgggaggcatgggctccatgggcgcgcagcccgtcacctccatgaacggcctgggtccctacgccgccgccatgaacccgtgcatgagtcccatggcgtacgcgccgtccaacctgggccgcagccgcgcggggggcggcggcgacgccaagacattcaagcgcagctaccctcacgccaagccgccttactcctacatctcgctcatcacgatggccatccagcaggcgcccagcaagatgctcacgctgagcgagatctaccagtggatcatggacctcttcccctattaccgccagaaccagcagcgctggcagaactccatccgccactcgctgtccttcaacgattgtttcgtcaaggtggcacgatccccagacaagccaggcaagggctcctactggacgctgcacccggactccggcaacatgttcgagaacggctgctacttgcgccgccaaaagcgcttcaagtgtgagaagcagccgggggccggaggtgggagtgggggcggcggctccaaagggggcccagaaagtcgcaaggacccctcaggcccggggaaccccagcgccgagtcaccccttcattggggtgtgcacggaaaggctagccagctagagggcgcgccggcccccgggcccgccgccagcccccagactctggaccacagcggggccacggcgacagggggcgcttcggagttgaagtctccagcgtcttcatctgcgccccccataagctccgggccaggggcgctggcatctgtacccccctctcacccggctcacggcctggcaccccacgaatctcagctgcatctgaaaggggatccccactactcctttaatcaccccttctccatcaacaacctcatgtcctcctccgagcaacagcacaagctggacttcaaggcatacgagcaggcgctgcagtactctccttatggcgctaccttgcccgccagtctgccccttggcagcgcctcagtggccacgaggagccccatcgagccctcagccctggagccagcctactaccaaggtgtgtattccagacccgtgctaaatacttcctag

SEQ ID NO: 48 - DNA, 1062 bp, Mus musculus
atgctgggctcagtgaagatggaggctcatgacctggccgagtggagctactacccggaggcgggcgaggtgtattctccagtgaatcctgtgcccaccatggcccctctcaactcctacatgaccttgaacccactcagctctccctaccctcccggagggcttcaggcctccccactgcctacaggacccctggcacccccagcccccactgcgcccttggggcccaccttcccaagcttgggcactggtggcagcaccggaggcagtgcttccgggtatgtagccccagggcccgggcttgtacatggaaaagagatggcaaaggggtaccggcggccactggcccacgccaaaccaccatattcctacatctctctcataaccatggctattcagcaggctccaggcaagatgctgaccctgagtgaaatctaccaatggatcatggacctcttcccgtactaccgggagaaccagcaacgttggcagaactccatccggcattcgctgtccttcaatgactgcttcgtcaaggtggcacgctccccagacaagccaggcaaaggctcctactgggccttgcatcccagctctgggaacatgtttgagaacggatgctatctccgccggcagaagcgcttcaagctggaggagaaggcaaagaaaggaaacagcgccacatcggccagcaggaatggtactgcggggtcagccacctctgccaccactacagctgccactgcagtcacctccccggctcagccccagcctacgccatctgagcccgaggcccagagtggggatgatgtggggggtctggactgcgcctcacctccttcgtccacaccttatttcagcggcctggagctcccgggggaactaaagttggatgcgccctataacttcaaccaccctttctctatcaacaacctgatgtcagaacagacatcgacaccttccaaactggatgtggggtttgggggctacggggctgagagtggggagcctggagtctactaccagagcctctattcccgctctctgcttaatgcatcctag

SEQ ID NO: 49 - DNA, 1380 bp, Mus musculus
atgctgggagccgtgaagatggaagggctcgagccatccgactggagcagctactacgcggagcccgagggctactcttccgtgagcaacatgaacgccggcctggggatgaatggcatgaacacatacatgagcatgtccgcggctgccatgggcggcggttccggcaacatgagcgcgggctccatgaacatgtcatcctatgtgggcgctggaatgagcccgtcgctagctggcatgtccccgggcgccggcgccatggcgggcatgagcggctcagccggggcggccggcgtggcgggcatgggacctcacctgagtccgagtctgagcccgctcgggggacaggcggccggggccatgggtggccttgccccctacgccaacatgaactcgatgagccccatgtacgggcaggccggcctgagccgcgctcgggaccccaagacataccgacgcagctacacacacgccaaacctccctactcgtacatctcgctcatcaccatggccatccagcagagccccaacaagatgctgacgctgagcgagatctatcagtggatcatggacctcttccctttctaccggcagaaccagcagcgctggcagaactccatccgccactctctctccttcaacgactgctttctcaaggtgccccgctcgccagacaagcctggcaagggctccttctggaccctgcacccagactcgggcaacatgttcgagaacggctgctacctgcgccgccagaagcgcttcaagtgtgagaagcaactggcactgaaggaagccgcgggtgcggccagtagcggaggcaagaagaccgctcctgggtcccaggcctctcaggctcagctcggggaggccgcgggctcggcctccgagactccggcgggcaccgagtccccccattccagcgcttctccgtgtcaggagcacaagcgaggtggcctaagcgagctaaagggagcacctgcctctgcgctgagtcctcccgagccggcgccctcgcctgggcagcagcagcaggctgcagcccacctgctgggcccacctcaccacccaggcctgccaccagaggcccacctgaagcccgagcaccattacgccttcaaccaccccttctctatcaacaacctcatgtcgtccgagcagcaacatcaccacagccaccaccaccatcagccccacaaaatggacctcaaggcctacgaacaggtcatgcactacccagggggctatggttcccccatgccaggcagcttggccatgggcccagtcacgaacaaagcgggcctggatgcctcgcccctggctgcagacacttcctactaccaaggagtgtactccaggcctattatgaactcatcctaa

SEQ ID NO: 50 - DNA, 1053 bp, Homo sapiens
atgctgggctcagtgaagatggaggcccatgacctggccgagtggagctactacccggaggcgggcgaggtctactcgccggtgaccccagtgcccaccatggcccccctcaactcctacatgaccctgaatcctctaagctctccctatccccctggggggctccctgcctccccactgccctcaggacccctggcacccccagcacctgcagcccccctggggcccactttcccaggcctgggtgtcagcggtggcagcagcagctccgggtacggggccccgggtcctgggctggtgcacgggaaggagatgccgaaggggtatcggcggcccctggcacacgccaagccaccgtattcctatatctcactcatcaccatggccatccagcaggcgccgggcaagatgctgaccttgagtgaaatctaccagtggatcatggacctcttcccttactaccgggagaatcagcagcgctggcagaactccattcgccactcgctgtctttcaacgactgcttcgtcaaggtggcgcgttccccagacaagcctggcaagggctcctactgggccctacaccccagctcagggaacatgtttgagaatggctgctacctgcgccgccagaaacgcttcaagctggaggagaaggtgaaaaaagggggcagcggggctgccaccaccaccaggaacgggacagggtctgctgcctcgaccaccacccccgcggccacagtcacctccccgccccagcccccgcctccagcccctgagcctgaggcccagggcggggaagatgtgggggctctggactgtggctcacccgcttcctccacaccctatttcactggcctggagctcccaggggagctgaagctggacgcgccctacaacttcaaccaccctttctccatcaacaacctaatgtcagaacagacaccagcacctcccaaactggacgtggggtttgggggctacggggctgaaggtggggagcctggagtctactaccagggcctctattcccgctctttgcttaatgcatcctag

SEQ ID NO: 51 - DNA, 1422 bp, Homo sapiens
atgttaggaactgtgaagatggaagggcatgaaaccagcgactggaacagctactacgcagacacgcaggaggcctactcctcggtcccggtcagcaacatgaactcaggcctgggctccatgaactccatgaacacctacatgaccatgaacaccatgactacgagcggcaacatgaccccggcgtccttcaacatgtcctatgccaacccggccttaggggccggcctgagtcccggcgcagtagccggcatgccggggggctcggcgggcgccatgaacagcatgactgcggccggcgtgacggccatgggtacggcgctgagcccgagcggcatgggcgccatgggtgcgcagcaggcggcctccatgatgaatggcctgggcccctacgcggccgccatgaacccgtgcatgagccccatggcgtacgcgccgtccaacctgggccgcagccgcgcgggcggcggcggcgacgccaagacgttcaagcgcagttacccgcacgccaagccgccctactcgtacatctcgctcatcaccatggccatccagcgggcgcccagcaagatgctcacgctgagcgagatctaccagtggatcatggacctcttcccctattaccggcagaaccagcagcgctggcagaactccatccgccactcgctgtccttcaatgactgcttcgtcaaggtggcacgctccccggacaagccgggcaagggctcctactggacgctgcacccggactccggcaacatgttcgagaacggctgctacttgcgccgccagaagcgcttcaagtgcgagaagcagccgggggccggcggcgggggcgggagcggaagcgggggcagcggcgccaagggcggccctgagagccgcaaggacccctctggcgcctctaaccccagcgccgactcgcccctccatcggggtgtgcacgggaagaccggccagctagagggcgcgccggccccgggcccggccgccagcccccagactctggaccacagtggggcgacggcgacagggggcgcctcggagttgaagactccagcctcctcaactgcgccccccataagctccgggcccggggcgctggcctctgtgcccgcctctcacccggcacacggcttggcaccccacgagtcccagctgcacctgaaaggggacccccactactccttcaaccacccgttctccatcaacaacctcatgtcctcctcggagcagcagcataagctggacttcaaggcatacgaacaggcactgcaatactcgccttacggctctacgttgcccgccagcctgcctctaggcagcgcctcggtgaccaccaggagccccatcgagccctcagccctggagccggcgtactaccaaggtgtgtattccagacccgtcctaaacacttcctag

SEQ ID NO: 52 - DNA, 1425 bp, Mus musculus
atgcgactctctaaaacccttgccggcatggatatggccgactacagcgctgccctggacccagcctacaccaccctggagtttgaaaatgtgcaggtgttgaccatgggcaatgacacgtccccatctgaaggtgccaacctcaattcatccaacagcctgggcgtcagtgccctgtgcgccatctgtggcgaccgggccaccggcaaacactacggagcctcgagctgtgacggctgcaaggggttcttcaggaggagcgtgaggaagaaccacatgtactcctgcaggtttagccgacaatgtgtggtagacaaagataagaggaaccagtgtcgttactgcaggcttaagaagtgcttccgggctggcatgaagaaggaagctgtccaaaatgagcgggaccggatcagcacgcggaggtcaagctacgaggacagcagcctgccctccatcaacgcgctcctgcaggcagaggttctgtcccagcagatcacctctcccatctctgggatcaatggcgacattcgggcaaagaagattgccaacatcacagacgtgtgtgagtctatgaaggagcagctgctggtcctggtcgagtgggccaagtacatcccggccttctgcgaactccttctggatgaccaggtggcgctgctcagggcccacgccggtgagcatctgctgcttggagccaccaagaggtccatggtgtttaaggacgtgctgctcctaggcaatgactacatcgtccctcggcactgtccagagctagcggagatgagccgtgtgtccatccgcatcctcgatgagctggtcctgcccttccaagagctgcagattgatgacaatgaatatgcctgcctcaaagccatcatcttctttgatccagatgccaaggggctgagtgacccgggcaagatcaagcggctgcggtcacaggtgcaagtgagcctggaggattacatcaacgaccggcagtacgactctcggggccgctttggagagctgctgctgctgttgcccacgctgcagagcatcacctggcagatgatcgaacagatccagttcatcaagctcttcggcatggccaagattgacaacctgctgcaggagatgcttctcggagggtctgccagtgatgcaccccacacccaccaccccctgcaccctcacctgatgcaagaacacatgggcaccaatgtcattgttgctaacacgatgccctctcacctcagcaatggacagatgtgtgagtggccccgacccagggggcaggcagccactcccgagactccacagccatcaccaccaagtggctcgggatctgaatcctacaagctcctgccaggagccatcaccaccatcgtcaagcctccctctgccattccccagccaacgatcaccaagcaagaagccatctag

SEQ ID NO: 53 - DNA, 1398 bp, Rattus norvegicus
atggacatggctgactacagtgctgccttggacccagcctacaccaccctggagtttgaaaatgtgcaggtgttgaccatgggcaatgacacatccccatctgaaggtgccaacctcaactcatccaacagcctgggtgtcagtgccctgtgtgccatctgtggcgatcgggccactggcaaacactacggagcctcaagctgtgacggctgcaagggattcttcaggaggagcgtgaggaagaaccacatgtactcctgcaggtttagcaggcagtgcgtggtagacaaagataagaggaaccagtgtcgttactgcaggctcaagaagtgcttccgggctggcatgaagaaagaagccgtccaaaatgagcgggatcggatcagcacgcggaggtcaagctacgaggacagcagcctaccctccattaatgcgctcctgcaggcagaggtcctgtctcagcagatcacctcccccatctctgggatcaatggcgacattcgggccaagaagattgccaacatcacggatgtgtgtgagtctatgaaggagcagctgctggttctggtcgaatgggccaagtacatcccggccttctgtgaacttcttctggatgaccaggtggcgctgctcagagcccacgctggtgagcacctgctgcttggagccaccaagaggtccatggtgttcaaggatgtgctgctcctaggcaatgactacatcgtccctcggcactgtccagagctagcagagatgagccgtgtgtccattcgcatcctcgatgagctggtcttgcccttccaagagctgcagatcgatgataatgaatacgcctgcctcaaagccatcatcttctttgacccagatgccaaggggctgagtgacccaggcaagatcaagcggctgcggtcacaggtgcaggtgagcctggaggattacatcaacgaccggcagtatgactctcggggtcgttttggagagctgctgctgctcctgcccactctgcagagcattacctggcagatgatcgagcagatccagttcatcaagctctttggcatggccaagattgacaacctgctgcaggagatgctgcttggagggtctgccagtgacgcgccccacgcccaccaccccctgcaccctcacctgatgcaagaacacatgggcaccaatgtcatagttgccaacacgatgccctctcacctcagcaatggacagatgtgtgagtggccccggcccagggggcaggcagccacccctgagactccacagccatcaccaccaagtggctctggatctgaatcctacaagctcctgccaggagccatcaccaccatcgtcaagcctccctctgccatcccccagccaacgatcaccaagcaggaagccatctag

SEQ ID NO: 54 - DNA, 1398 bp, Mus musculus
atgaacgcacagctgaccatggaggcgatcggcgagctgcacggggtgagccatgagccggtgcccgcccctgctgacctgctgggcggcagccctcacgcgcgcagctccgtgggacaccgcggcagccacctgcctcccgcgcacccgcgttccatgggcatggcgtccctgctggacggcggcagcggaggcagcgattaccaccaccaccaccgcgcccctgagcacagcttggctggccccctgcaccccaccatgaccatggcctgtgaaactcccccaggtatgagcatgcccaccacctacactaccttaacccctctgcagccgctgccgcccatctccaccgtgtccgacaagttccctcaccatcatcaccaccaccatcaccaccaccacccacaccaccaccagcgcctggcgggcaacgtgagcggtagtttcacacttatgcgggatgagcgcgggctggcctctatgaataacctctataccccctaccacaaggacgtggctggcatgggccagagcctctcgcccctctctggctccggtctgggcagcattcacaactcccagcaaggacttccccactatgctcatcccggcgcggctatgcccaccgacaagatgctcaccccaaatggctttgaagcccaccaccctgccatgctcggtcgccacggggagcagcacctcacgcccacctcggccggcatggtacccatcaacggccttcctccgcaccatcctcatgcccacctgaatgcccagggccacggacagctcctgggcacagcccgagagcccaacccttcggtgaccggcgcgcaggtcagcaatggaagtaattcagggcagatggaagagatcaataccaaagaggtggcgcagcgtatcaccaccgagctcaaacgttacagcatcccacaggccatcttcgcgcagagggtgctctgccgttcccaggggaccctttcggacctgctgcgaaaccccaagccctggagcaaactcaagtcgggtcgggagaccttccggaggatgtggaagtggctgcaggagccggagttccagcgcatgtcggcgctccgcttagcagcctgcaaacggaaagagcaagaacatgggaaggacagaggcaacacccccaaaaagcccaggctggtcttcacagacgtccaacgtcgaactctacatgcaatattcaaggaaaataagcgtccgtccaaagaattacaaatcaccatctcccagcagctggggttggagctgagcactgtcagcaacttcttcatgaatgccagaaggaggagtctggacaagtggcaggacgagggcggctccaactcaggcagttcatcgtcctcatcgagcacttgtaccaaagcatga

SEQ ID NO: 55 - DNA, 1002 bp, Xenopus laevis
atggagaagtccaagaatttcaggattgacgctctcctggcgatagatccccccaaggctcagacctccccattggctctggtcacctcgctgtcctcctcgtctctctccgggagccccccgtccgagcacactgacagcctcaggactgactccccctcccctccaaggacttgtggactggtccctaaaccaggtttcctgagcagccaccagcaccccccaaacatgatgtcattgcacccccaggctgctccagggatcccccctcaggccctgtatggacacccgatgtacagctacttggcagcggggcagcacccagctctgtcctacccctactcccagatgcagagcagccaccacccccaccccatggaccccatcaagatcagcgctggcaccttccaactggaccagtggctcagagcctccactgccggcatgatgctgcccaaaatggcagactttaactcccaggcccaatccaacctgctgggaaagtgcagaagaccaaggacagcgtttaccagtcagcagctgttggaactggagcaccaattcaagctgaacaagtacctctccaggccgaaacgctttgaagtggccacttccctgatgctcactgagacgcaggtgaagatctggttccagaacaggcgcatgaaatggaagaggagtaagaaagccaaggagcaggcggcgcaggactcagcagagaaacagcagagggcaggcaagggcagcagcgaggagaagtgctcggatgagctgcaggaagagaagaaatcctaccatctccatcccaggggggagcccatcaaagggaacggccgcctgcagcccagagactatacagacagcgaagaggacgaggaggaggacagggaagaggaggaagaggaagatcacagaggggaggggaagcggttttaccatcattcttctgactgcacatccgaggaagaggagaacagccacaataagcagagcggccactga

SEQ ID NO: 56 - DNA, 1215 bp, Mus musculus
atggaaaaatccaaaaatttccgcatcgacgccctgctggccgtggatcccccgcgagccgcctccacgcagagcgcgcctctggccttggtcacttccctcgcgactacagtatctggtcccggccgcggcggcagcggcggcggggggaccagtagcggggcgagccgtagctgcagtcccgcatcctcggaggccactgcagcgcccggtgaccggctgagagctgagagcccgtcgcccccacgcttgctggctgcacactgcgcgctgctgcccaagcccggattcctgggcgccggaggaggcggcggcgcggcgggtgggccgggcactccccaccaccacgcgcaccctggtgcagcagccgccgcggctgccgctgccgctgccgcggctgccggtggcctggcactggggctgcacccggggggcgcacagggcggcgcgggcctccctgcacaggcggctctctatggacacccggtctacagttattcggcagcagctgcagcggccgcgctagctggccagcacccggcgctttcctactcataccctcaggtgcagggcgcgcaccctgcgcaccctgccgaccccatcaagctgggtgccagcaccttccaactggaccagtggctgcgcgcgtctactgcgggcatgatcctgcccaagatgccggacttcagctgtcaggcgcagtcgaacctcttggggaagtgccgaaggcctcgcacggccttcaccagccagcagctgttggagctggaacaccagttcaagctcaacaagtacctgtctcgacccaagcgttttgaggtggctacctcgctcatgctcaccgagactcaggtgaagatttggttccagaaccgccgaatgaaatggaaacgcagcaaaaaggccaaagagcaggctgcgcaggaggcggagaagcagaagggcggcggcgggggcaccggcaaaggcggcagtgaggagaagacggaagaggagctgatggggcctccggtttcgggggacaaggcaagcggccgtcgcctgcgggacttgcgggacagtgaccctgatgaggacgaggatgatgaagaagaggacaacttcccgtacagcaatggtgccggtgcccatgctgcctcatccgactgctcatctgaggacgactcgcctcctccaagactaggcgggcctggacaccaacctctgccccagtag

SEQ ID NO: 57 - DNA, 1215 bp, Homo sapiens; identical to SEQ ID NO: 56

SEQ ID NO: 58 - DNA, 846 bp, Homo sapiens
atgacttccaaggaggacggcaaggcggcgccgggggaggagcggcggcgcagcccgctggaccacctgcctccgcctgccaactccaacaagccactgacgccgttcagcatcgaggacatcctcaacaagccgtctgtgcggagaagttactcgctgtgcggggcggcgcacctgctggccgccgcggacaagcacgcgcagggcggcttgcccctggcgggccgcgcgctgctctcgcagacctcgccgctgtgcgcgctggaggagctcgccagcaagacgtttaaggggctggaggtcagcgttctgcaggcagccgaaggccgcgacggtatgaccatctttgggcagcggcagacccctaagaagcggcgaaagtcgcgcacggccttcaccaaccaccagatctatgaattggaaaagcgctttctataccagaagtacctgtcccccgccgatcgcgaccaaatcgcgcagcagctgggcctcaccaacgcgcaagtcatcacctggttccagaatcggcgcgctaagctcaagcgggacctggaggagatgaaggccgacgtagagtccgccaagaaactgggccccagcgggcagatggacatcgtggcgctggccgaactcgagcagaactcggaggccacagccggcggtggcggcggctgcggcagggccaagtcgaggcccggctctccggtcctccccccaggcgccccgaaggccccgggcgctggcgccctgcagctctcgcctgcctctccgctcacggaccagccggccagcagccaggactgctcggaggacgaggaagacgaagagatcgacgtggacgattga

SEQ ID NO: 59 - DNA, 1119 bp, Mus musculus
atgttggacggcatcaagatggaggagcacgccctgcgccccgggcccgccactctgggggtgctgctgggctccgactgcccgcatcccgccgtctgcgagggctgccagcggcccatctccgaccgcttcctgatgcgagtcaacgagtcgtcctggcacgaggagtgtttgcagtgcgcggcgtgtcagcaagccctcaccaccagctgctacttccgggatcggaaactgtactgcaaacaagactaccaacagctcttcgcggccaagtgcagcggctgcatggagaagatcgcccccaccgagttcgtgatgcgggcgctggagtgcgtgtaccacctgggctgcttctgctgctgcgtgtgtgaacggcagctacgcaagggcgacgaattcgtgctcaaggagggccagctgctgtgcaagggtgactacgagaaggagaaggacctgctcagctccgtgagccccgacgagtccgactccgtgaagagcgaggatgaagatggggacatgaagccggccaaggggcagggcagtcagagcaagggcagcggggatgacgggaaggacccgcggaggcccaagcgaccccggaccatcctcaccacgcagcagcgaagagccttcaaggcctccttcgaggtctcgtcgaagccttgccgaaaggtccgagagacactggcagctgagacgggcctcagtgtgcgcgtggtccaggtctggtttcagaaccaaagagcaaagatgaagaagctggcgcggcggcaccagcagcagcaggagcagcagaactcccagcggctgggccaggaggtcctgtccagccgcatggagggcatgatggcttcctacacgccgctggccccaccacagcagcagatcgtggccatggaacagagcccctacggcagcagcgaccccttccagcagggcctcacgccgccccaaatgccagggaacgactccatcttccatgacatcgacagcgatacctccttaaccagcctcagcgactgcttcctcggctcctcagacgtgggctccctgcaggcccgcgtggggaaccccatcgaccggctctactccatgcagagttcctacttcgcctcctga

SEQ ID NO: 60 - DNA, 714 bp, Homo sapiens
atgccagcccgccttgagacctgcatctccgacctcgactgcgccagcagcagcggcagtgacctatccggcttcctcaccgacgaggaagactgtgccagactccaacaggcagcctccgcttcggggccgcccgcgccggcccgcaggggcgcgcccaatatctcccgggcgtctgaggttccaggggcacaggacgacgagcaggagaggcggcggcgccgcggccggacgcgggtccgctccgaggcgctgctgcactcgctgcgcaggagccggcgcgtcaaggccaacgatcgcgagcgcaaccgcatgcacaacttgaacgcggccctggacgcactgcgcagcgtgctgccctcgttccccgacgacaccaagctcaccaaaatcgagacgctgcgcttcgcctacaactacatctgggctctggccgagacactgcgcctggcggatcaagggctgcccggaggcggtgcccgggagcgcctcctgccgccgcagtgcgtcccctgcctgcccggtcccccaagccccgccagcgacgcggagtcctggggctcaggtgccgccgccgcctccccgctctctgaccccagtagcccagccgcctccgaagacttcacctaccgccccggcgaccctgttttctccttcccaagcctgcccaaagacttgctccacacaacgccctgtttcattccttaccactag

SEQ ID NO: 61 - DNA, 819 bp, Homo sapiens
atgttcgtcaaatccgagaccttggagttgaaggaggaagaggacgtgttagtgctgctcggatcggcctcccccgccttggcggccctgaccccgctgtcatccagcgccgacgaagaagaggaggaggagccgggcgcgtcaggcggggcgcgtcggcagcgcggggctgaggccgggcagggggcgcggggcggcgtggctgcgggtgcggagggctgccggcccgcacggctgctgggtctggtacacgattgcaaacggcgcccttcccgggcgcgggccgtctcccgaggcgccaagacggccgagacggtgcagcgcatcaagaagacccgtagactgaaggccaacaaccgcgagcgaaaccgcatgcacaacctcaacgcggcactggacgcgctgcgcgaggtgctccccacgttccccgaggacgccaagctcaccaagatcgagaccctgcgcttcgcccacaactacatctgggcactcaccgagaccctgcgcctggcggatcactgcgggggcggcggcgggggcctgccgggggcgctcttctccgaggcagtgttgctgagcccgggaggcgccagcgccgccctgagcagcagcggagacagcccctcgcccgcctccacgtggagttgcaccaacagccccgcgccgtcctcctccgtgtcctccaattccacctccccctacagctgcactttatcgcccgccagcccggccgggtcagacatggactattggcagcccccacctcccgacaagcaccgctatgcacctcacctccccatagccagggattgtatctag

SEQ ID NO: 62 - DNA, 645 bp, Mus musculus
atgacgcctcaaccctcgggtgcgcccactgtccaagtgacccgtgagacggagcggtccttccccagagcctcggaagacgaagtgacctgccccacgtccgccccgcccagccccactcgcacacgggggaactgcgcagaggcggaagagggaggctgccgaggggccccgaggaagctccgggcacggcgcgggggacgcagccggcctaagagcgagttggcactgagcaagcagcgacggagtcggcgaaagaaggccaacgaccgcgagcgcaatcgaatgcacaacctcaactcggcactggacgccctgcgcggtgtcctgcccaccttcccagacgacgcgaagctcaccaagatcgagacgctgcgcttcgcccacaactacatctgggcgctgactcaaacgctgcgcatagcggaccacagcttgtacgcgctggagccgccggcgccgcactgcggggagctgggcagcccaggcggttcccccggggactgggggtccctctactccccagtctcccaggctggcagcctgagtcccgccgcgtcgctggaggagcgacccgggctgctgggggccaccttttccgcctgcttgagcccaggcagtctggctttctcagattttctgtga

SEQ ID NO: 63 - DNA, 711 bp, Homo sapiens
atggaaagctctgccaagatggagagcggcggcgccggccagcagccccagccgcagccccagcagcccttcctgccgcccgcagcctgtttctttgccacggccgcagccgcggcggccgcagccgccgcagcggcagcgcagagcgcgcagcagcagcagcagcagcagcagcagcagcagcaggcgccgcagctgagaccggcggccgacggccagccctcagggggcggtcacaagtcagcgcccaagcaagtcaagcgacagcgctcgtcttcgcccgaactgatgcgctgcaaacgccggctcaacttcagcggctttggctacagcctgccgcagcagcagccggccgccgtggcgcgccgcaacgagcgcgagcgcaaccgcgtcaagttggtcaacctgggctttgccacccttcgggagcacgtccccaacggcgcggccaacaagaagatgagtaaggtggagacactgcgctcggcggtcgagtacatccgcgcgctgcagcagctgctggacgagcatgacgcggtgagcgccgccttccaggcaggcgtcctgtcgcccaccatctcccccaactactccaacgacttgaactccatggccggctcgccggtctcatcctactcgtcggacgagggctcttacgacccgctcagccccgaggagcaggagcttctcgacttcaccaactggttctga

SEQ ID NO: 64 - DNA, 957 bp, Mus musculus
atggagcttctatcgccgccactccgggacatagacttgacaggccccgacggctctctctgctcctttgagacagcagacgacttctatgatgacccgtgtttcgactcaccagacctgcgcttttttgaggacctggacccgcgcctggtgcacatgggagccctcctgaaaccggaggagcacgcacacttccctactgcggtgcacccaggcccaggcgctcgtgaggatgagcatgtgcgcgcgcccagcgggcaccaccaggcgggtcgctgcttgctgtgggcctgcaaggcgtgcaagcgcaagaccaccaacgctgatcgccgcaaggccgccaccatgcgcgagcgccgccgcctgagcaaagtgaatgaggccttcgagacgctcaagcgctgcacgtccagcaacccgaaccagcggctacccaaggtggagatcctgcgcaacgccatccgctacatcgaaggtctgcaggctctgctgcgcgaccaggacgccgcgccccctggcgccgctgccttctacgcacctggaccgctgcccccaggccgtggcagcgagcactacagtggcgactcagatgcatccagcccgcgctccaactgctctgatggcatgatggattacagcggccccccaagcggcccccggcggcagaatggctacgacaccgcctactacagtgaggcggcgcgcgagtccaggccagggaagagtgcggctgtgtcgagcctcgactgcctgtccagcatagtggagcgcatctccacagacagccccgctgcgcctgcgctgcttttggcagatgcaccaccagagtcgcctccgggtccgccagagggggcatccctaagcgacacagaacagggaacccagaccccgtctcccgacgccgcccctcagtgtcctgcaggctcaaaccccaatgcgatttatcaggtgctttga

SEQ ID NO: 65 - DNA, 963 bp, Homo sapiens
atggagctactgtcgccaccgctccgcgacgtagacctgacggcccccgacggctctctctgctcctttgccacaacggacgacttctatgacgacccgtgtttcgactccccggacctgcgcttcttcgaagacctggacccgcgcctgatgcacgtgggcgcgctcctgaaacccgaagagcactcgcacttccccgcggcggtgcacccggccccgggcgcacgtgaggacgagcatgtgcgcgcgcccagcgggcaccaccaggcgggccgctgcctactgtgggcctgcaaggcgtgcaagcgcaagaccaccaacgccgaccgccgcaaggccgccaccatgcgcgagcggcgccgcctgagcaaagtaaatgaggcctttgagacactcaagcgctgcacgtcgagcaatccaaaccagcggttgcccaaggtggagatcctgcgcaacgccatccgctatatcgagggcctgcaggctctgctgcgcgaccaggacgccgcgccccctggcgccgcagccgccttctatgcgccgggcccgctgcccccgggccgcggcggcgagcactacagcggcgactccgacgcgtccagcccgcgctccaactgctccgacggcatgatggactacagcggccccccgagcggcgcccggcggcggaactgctacgaaggcgcctactacaacgaggcgcccagcgaacccaggcccgggaagagtgcggcggtgtcgagcctagactgcctgtccagcatcgtggagcgcatctccaccgagagccctgcggcgcccgccctcctgctggcggacgtgccttctgagtcgcctccgcgcaggcaagaggctgccgcccccagcgagggagagagcagcggcgaccccacccagtcaccggacgccgccccgcagtgccctgcgggtgcgaaccccaacccgatataccaggtgctctga

SEQ ID NO: 66 - DNA, 768 bp, Homo sapiens
atggacgtgatggatggctgccagttctcaccttctgagtacttctacgacggctcctgcataccgtcccccgagggtgaatttggggacgagtttgtgccgcgagtggctgccttcggagcgcacaaagcagagctgcagggctcagatgaggacgagcacgtgcgagcgcctaccggccaccaccaggctggtcactgcctcatgtgggcctgcaaagcctgcaagaggaagtccaccaccatggatcggcggaaggcagccactatgcgcgagcggaggcgcctgaagaaggtcaaccaggctttcgaaaccctcaagaggtgtaccacgaccaaccccaaccagaggctgcccaaggtggagatcctcaggaatgccatccgctacatcgagagcctgcaggagttgctgagagagcaggtggagaactactatagcctgccgggacagagctgctcggagcccaccagccccacctccaactgctctgatggcatgcccgaatgtaacagtcctgtctggtccagaaagagcagtacttttgacagcatctactgtcctgatgtatcaaatgtatatgccacagataaaaactccttatccagcttggattgcttatccaacatagtggaccggatcacctcctcagagcaacctgggttgcctctccaggatctggcttctctctctccagttgccagcaccgattcacagcctgcaactccaggggcttctagttccaggcttatctatcatgtgctatga

SEQ ID NO: 67 - DNA, 729 bp, Homo sapiens
atgatgatggacctttttgaaactggctcctatttcttctacttggatggggaaaatgttactctgcagccattagaagtggcagaaggctctcctttgtatccagggagtgatggtaccttgtccccctgccaggaccaaatgcccccggaagcggggagcgacagcagcggagaggaacatgtcctggcgcccccgggcctgcagcctccacactgccccggccagtgtctgatctgggcttgcaagacctgcaagagaaaatctgcccccactgaccggcgaaaagccgccaccctgcgcgaaaggaggaggctaaagaaaatcaacgaggccttcgaggcactgaagcggcgaactgtggccaaccccaaccagaggctgcccaaggtggagattctgcggagcgccatcagctatattgagcggctgcaggacctgctgcaccggctggatcagcaggagaagatgcaggagctgggggtggaccccttcagctacagacccaaacaagaaaatcttgagggtgcggatttcctgcgcacctgcagctcccagtggccaagtgtttccgatcattccagggggctcgtgataacggctaaggaaggaggagcaagtattgattcgtcagcctcgagtagccttcgatgcctttcttccatcgtggacagtatttcctcggaggaacgcaaactcccctgcgtggaggaagtggtggagaagtaa

SEQ ID NO: 68 - DNA, 1356 bp, Homo sapiens
atgccgaagaacaagaagcggaacactccccaccgcggtagcagtgctggcggcggcgggtcaggagcagccgcagcgacggcggcgacagcaggtggccagcatcgaaatgttcagccttttagtgatgaagatgcatcaattgaaacaatgagccattgcagtggttatagcgatccttccagttttgctgaagatggaccagaagtccttgatgaggaaggaactcaagaagacctagagtacaagttgaagggattaattgacctaaccctggataagagtgcgaagacaaggcaagcagctcttgaaggtattaaaaatgcactggcttcaaaaatgctgtatgaatttattctggaaaggagaatgactttaactgatagcattgaacgctgcctgaaaaaaggtaagagtgatgagcaacgtgcagctgcagcgttagcatctgttctttgtattcagctgggccctggaattgaaagtgaagagattttgaaaactcttggaccaatcctaaagaaaatcatttgtgatgggtcagctagtatgcaggctaggcaaacttgtgcaacttgctttggtgtttgctgttttattgccacagatgacattactgaactatactcaactctggaatgtttggaaaatatcttcactaaatcctatctcaaagagaaagacactactgttatttgcagcactcctaatacagtgcttcatatcagctctcttcttgcatggacactactgctgaccatatgcccaatcaatgaagtgaagaaaaagcttgagatgcatttccataagcttccaagcctcctctcttgtgatgatgtaaacatgagaatagctgctggtgaatctttggcacttctctttgaattggccagaggaatagagagtgactttttttatgaagacatggagtccttgacgcagatgcttagggccttggcaacagatggaaataaacaccgggccaaagtggacaagagaaagcagcggtcagttttcagagatgtcctgagggcagtggaggaacgggattttccaacagaaaccattaaatttggtcctgaacgcatgtatattgattgctgggtaaaaaaacacacctatgacacctttaaggaggttcttggatcagggatgcagtaccacttgcagtcaaatgaattccttcgaaatgtatttgaacttggacccccagtgatgcttgatgctgcaacgcttaaaacgatgaagatttctcgtttcgaaaggcatttatataactctgcagccttcaaagctcgaaccaaagctagaagcaaatgtcgagataagagagcagatgttggagaattcttctag

SEQ ID NO: 69 - DNA, 1524 bp, Rattus norvegicus
atggggcggaagaaaatacaaatcacacgcataatggatgaaaggaaccgacaggtcacttttacaaagagaaagtttggattaatgaagaaagcctatgaacttagtgtgctctgtgactgtgaaatagcactcatcattttcaacagctctaacaaactgtttcaatatgctagcactgatatggacaaagttcttctcaagtatacagaatataatgaacctcatgaaagcagaaccaactcggatattgttgaggctctgaacaagaaggaacacagagggtgcgacagcccagaccctgatacttcatatgtgctaactccacatacagaagaaaaatataaaaaaattaatgaggaatttgataatatgatgcggaatcataaaatcgcacctggtctgccacctcagaacttttcaatgtctgtcacagttccagtgaccagccccaatgctttgtcctacactaacccagggagttcactggtgtccccatctttggcagccagctcaacgttaacagattcaagcatgctctctccacctcaaaccacattacatagaaatgtgtctcctggagctcctcagagaccaccaagtactggcaatgcaggtgggatgttgagcactacagacctcacagtgccaaatggagctggaagcagtccagtggggaatggatttgtaaactcaagagcttctccaaatttgattggagctactggtgcaaatagcttaggcaaagtcatgcctacaaagtctccccctccaccaggtggtggtaatcttggaatgaacagtaggaaaccagatcttcgagttgtcatccccccttcaagcaagggcatgatgcctccactatcggaggaagaggaattggagttgaacacccaaaggatcagtagttctcaagccactcaacctcttgctaccccagtcgtgtctgtgacaaccccaagcttgcctccgcaaggacttgtgtactcagcaatgccgactgcctacaacactgattattcactgaccagcgctgacctgtcagcccttcaaggcttcaactcgccaggaatgctgtcgctgggacaggtgtcggcctggcagcagcaccacctaggacaagcagccctcagctctcttgttgctggagggcagttatctcagggttccaatttatccattaataccaaccaaaacatcagcatcaagtccgaaccgatttcacctcctcgggatcgtatgaccccatcgggcttccagcagcagcagcagcagcagcagcagcagcagccgccgccaccaccgcagccccagccacaacccccgcagccccagccccgacaggaaatggggcgctcccctgtggacagtctgagcagctctagtagctcctatgatggcagtgatcgggaggatccacggggcgacttccattctccaattgtgcttggccgacccccaaacactgaggacagagaaagcccttctgtaaagcgaatgaggatggacgcgtgggtgacctaa

SEQ ID NO: 70 - DNA, 675 bp, Homo sapiens
atggagctgtatgagacatccccctacttctaccaggaaccccgcttctatgatggggaaaactacctgcctgtccacctccagggcttcgaaccaccaggctacgagcggacggagctcaccctgagccccgaggccccagggccccttgaggacaaggggctggggacccccgagcactgtccaggccagtgcctgccgtgggcgtgtaaggtgtgtaagaggaagtcggtgtccgtggaccggcggcgggcggccacactgagggagaagcgcaggctcaagaaggtgaatgaggccttcgaggccctgaagagaagcaccctgctcaaccccaaccagcggctgcccaaggtggagatcctgcgcagtgccatccagtacatcgagcgcctccaggccctgctcagctccctcaaccaggaggagcgtgacctccgctaccggggcgggggcgggccccagccaggggtgcccagcgaatgcagctctcacagcgcctcctgcagtccagagtggggcagtgcactggagttcagcgccaacccaggggatcatctgctcacggctgaccctacagatgcccacaacctgcactccctcacctccatcgtggacagcatcacagtggaagatgtgtctgtggccttcccagatgaaaccatgcccaactga

SEQ ID NO: 71 - DNA, 822 bp, Homo sapiens
atgtcgctgaccaacacaaagacggggttttcggtcaaggacatcttagacctgccggacaccaacgatgaggagggctctgtggccgaaggtccggaggaagagaacgaggggcccgagccagccaagagggccgggccgctggggcagggcgccctggacgcggtgcagagcctgcccctgaagaaccccttctacgacagcagcgacaacccgtacacgcgctggctggccagcaccgagggccttcagtactccctgcacggtctggctgccggggcgccccctcaggactcaagctccaagtccccggagccctcggccgacgagtcaccggacaatgacaaggagaccccgggcggcgggggggacgccggcaagaagcgaaagcggcgagtgcttttctccaaggcgcagacctacgagctggagcggcgctttcggcagcagcggtacctgtcggcgcccgagcgcgaacacctggccagcctcatccgcctcacgcccacgcaggtcaagatctggttccagaaccaccgctacaagatgaagcgcgcccgggccgagaaaggtatggaggtgacgcccctgccctcgccgcgccgggtggccgtgcccgtcttggtcagggacggcaaaccatgtcacgcgctcaaagcccaggacctggcagccgccaccttccaggcgggcattcccttttctgcctacagcgcgcagtcgctgcagcacatgcagtacaacgcccagtacagctcggccagcaccccccagtacccgacagcacaccccctggtccaggcccagcagtggacttggtga

SEQ ID NO: 72 - DNA, 7668 bp, Homo sapiens
atgccgccgctcctggcgcccctgctctgcctggcgctgctgcccgcgctcgccgcacgaggcccgcgatgctcccagcccggtgagacctgcctgaatggcgggaagtgtgaagcggccaatggcacggaggcctgcgtctgtggcggggccttcgtgggcccgcgatgccaggaccccaacccgtgcctcagcaccccctgcaagaacgccgggacatgccacgtggtggaccgcagaggcgtggcagactatgcctgcagctgtgccctgggcttctctgggcccctctgcctgacacccctggacaatgcctgcctcaccaacccctgccgcaacgggggcacctgcgacctgctcacgctgacggagtacaagtgccgctgcccgcccggctggtcagggaaatcgtgccagcaggctgacccgtgcgcctccaacccctgcgccaacggtggccagtgcctgcccttcgaggcctcctacatctgccactgcccacccagcttccatggccccacctgccggcaggatgtcaacgagtgtggccagaagcccgggctttgccgccacggaggcacctgccacaacgaggtcggctcctaccgctgcgtctgccgcgccacccacactggccccaactgcgagcggccctacgtgccctgcagcccctcgccctgccagaacgggggcacctgccgccccacgggcgacgtcacccacgagtgtgcctgcctgccaggcttcaccggccagaactgtgaggaaaatatcgacgattgtccaggaaacaactgcaagaacgggggtgcctgtgtggacggcgtgaacacctacaactgccgctgcccgccagagtggacaggtcagtactgtaccgaggatgtggacgagtgccagctgatgccaaatgcctgccagaacggcgggacctgccacaacacccacggtggctacaactgcgtgtgtgtcaacggctggactggtgaggactgcagcgagaacattgatgactgtgccagcgccgcctgcttccacggcgccacctgccatgaccgtgtggcctccttctactgcgagtgtccccatggccgcacaggtctgctgtgccacctcaacgacgcatgcatcagcaacccctgtaacgagggctccaactgcgacaccaaccctgtcaatggcaaggccatctgcacctgcccctcggggtacacgggcccggcctgcagccaggacgtggatgagtgctcgctgggtgccaacccctgcgagcatgcgggcaagtgcatcaacacgctgggctccttcgagtgccagtgtctgcagggctacacgggcccccgatgcgagatcgacgtcaacgagtgcgtctcgaacccgtgccagaacgacgccacctgcctggaccagattggggagttccagtgcatctgcatgcccggctacgagggtgtgcactgcgaggtcaacacagacgagtgtgccagcagcccctgcctgcacaatggccgctgcctggacaagatcaatgagttccagtgcgagtgccccacgggcttcactgggcatctgtgccagtacgatgtggacgagtgtgccagcaccccctgcaagaatggtgccaagtgcctggacggacccaacacttacacctgtgtgtgcacggaagggtacacggggacgcactgcgaggtggacatcgatgagtgcgaccccgacccctgccactacggctcctgcaaggacggcgtcgccaccttcacctgcctctgccgcccaggctacacgggccaccactgcgagaccaacatcaacgagtgctccagccagccctgccgccacgggggcacctgccaggaccgcgacaacgcctacctctgcttctgcctgaaggggaccacaggacccaactgcgagatcaacctggatgactgtgccagcagcccctgcgactcgggcacctgtctggacaagatcgatggctacgagtgtgcctgtgagccgggctacacagggagcatgtgtaacatcaacatcgatgagtgtgcgggcaacccctgccacaacgggggcacctgcgaggacggcatcaatggcttcacctgccgctgccccgagggctaccacgaccccacctgcctgtctgaggtcaatgagtgcaacagcaacccctgcgtccacggggcctgccgggacagcctcaacgggtacaagtgcgactgtgaccctgggtggagtgggaccaactgtgacatcaacaacaatgagtgtgaatccaacccttgtgtcaacggcggcacctgcaaagacatgaccagtggctacgtgtgcacctgccgggagggcttcagcggtcccaactgccagaccaacatcaacgagtgtgcgtccaacccatgtctgaaccagggcacgtgtattgacgacgttgccgggtacaagtgcaactgcctgctgccctacacaggtgccacgtgtgaggtggtgctggccccgtgtgcccccagcccctgcagaaacggcggggagtgcaggcaatccgaggactatgagagcttctcctgtgtctgccccacgggctggcaagggcagacctgtgaggtcgacatcaacgagtgcgttctgagcccgtgccggcacggcgcatcctgccagaacacccacggcggctaccgctgccactgccaggccggctacagtgggcgcaactgcgagaccgacatcgacgactgccggcccaacccgtgtcacaacgggggctcctgcacagacggcatcaacacggccttctgcgactgcctgcccggcttccggggcactttctgtgaggaggacatcaacgagtgtgccagtgacccctgccgcaacggggccaactgcacggactgcgtggacagctacacgtgcacctgccccgcaggcttcagcgggatccactgtgagaacaacacgcctgactgcacagagagctcctgcttcaacggtggcacctgcgtggacggcatcaactcgttcacctgcctgtgtccacccggcttcacgggcagctactgccagcacgatgtcaatgagtgcgactcacagccctgcctgcatggcggcacctgtcaggacggctgcggctcctacaggtgcacctgcccccagggctacactggccccaactgccagaaccttgtgcactggtgtgactcctcgccctgcaagaacggcggcaaatgctggcagacccacacccagtaccgctgcgagtgccccagcggctggaccggcctttactgcgacgtgcccagcgtgtcctgtgaggtggctgcgcagcgacaaggtgttgacgttgcccgcctgtgccagcatggagggctctgtgtggacgcgggcaacacgcaccactgccgctgccaggcgggctacacaggcagctactgtgaggacctggtggacgagtgctcacccagcccctgccagaacggggccacctgcacggactacctgggcggctactcctgcaagtgcgtggccggctaccacggggtgaactgctctgaggagatcgacgagtgcctctcccacccctgccagaacgggggcacctgcctcgacctccccaacacctacaagtgctcctgcccacggggcactcagggtgtgcactgtgagatcaacgtggacgactgcaatccccccgttgaccccgtgtcccggagccccaagtgctttaacaacggcacctgcgtggaccaggtgggcggctacagctgcacctgcccgccgggcttcgtgggtgagcgctgtgagggggatgtcaacgagtgcctgtccaatccctgcgacgcccgtggcacccagaactgcgtgcagcgcgtcaatgacttccactgcgagtgccgtgctggtcacaccgggcgccgctgcgagtccgtcatcaatggctgcaaaggcaagccctgcaagaatgggggcacctgcgccgtggcctccaacaccgcccgcgggttcatctgcaagtgccctgcgggcttcgagggcgccacgtgtgagaatgacgctcgtacctgcggcagcctgcgctgcctcaacggcggcacatgcatctccggcccgcgcagccccacctgcctgtgcctgggccccttcacgggccccgaatgccagttcccggccagcagcccctgcctgggcggcaacccctgctacaaccaggggacctgtgagcccacatccgagagccccttctaccgttgcctgtgccccgccaaattcaacgggctcttgtgccacatcctggactacagcttcgggggtggggccgggcgcgacatccccccgccgctgatcgaggaggcgtgcgagctgcccgagtgccaggaggacgcgggcaacaaggtctgcagcctgcagtgcaacaaccacgcgtgcggctgggacggcggtgactgctccctcaacttcaatgacccctggaagaactgcacgcagtctctgcagtgctggaagtacttcagtgacggccactgtgacagccagtgcaactcagccggctgcctcttcgacggctttgactgccagcgtgcggaaggccagtgcaaccccctgtacgaccagtactgcaaggaccacttcagcgacgggcactgcgaccagggctgcaacagcgcggagtgcgagtgggacgggctggactgtgcggagcatgtacccgagaggctggcggccggcacgctggtggtggtggtgctgatgccgccggagcagctgcgcaacagctccttccacttcctgcgggagctcagccgcgtgctgcacaccaacgtggtcttcaagcgtgacgcacacggccagcagatgatcttcccctactacggccgcgaggaggagctgcgcaagcaccccatcaagcgtgccgccgagggctgggccgcacctgacgccctgctgggccaggtgaaggcctcgctgctccctggtggcagcgagggtgggcggcggcggagggagctggaccccatggacgtccgcggctccatcgtctacctggagattgacaaccggcagtgtgtgcaggcctcctcgcagtgcttccagagtgccaccgacgtggccgcattcctgggagcgctcgcctcgctgggcagcctcaacatcccctacaagatcgaggccgtgcagagtgagaccgtggagccgcccccgccggcgcagctgcacttcatgtacgtggcggcggccgcctttgtgcttctgttcttcgtgggctgcggggtgctgctgtcccgcaagcgccggcggcagcatggccagctctggttccctgagggcttcaaagtgtctgaggccagcaagaagaagcggcgggagcccctcggcgaggactccgtgggcctcaagcccctgaagaacgcttcagacggtgccctcatggacgacaaccagaatgagtggggggacgaggacctggagaccaagaagttccggttcgaggagcccgtggttctgcctgacctggacgaccagacagaccaccggcagtggactcagcagcacctggatgccgctgacctgcgcatgtctgccatggcccccacaccgccccagggtgaggttgacgccgactgcatggacgtcaatgtccgcgggcctgatggcttcaccccgctcatgatcgcctcctgcagcgggggcggcctggagacgggcaacagcgaggaagaggaggacgcgccggccgtcatctccgacttcatctaccagggcgccagcctgcacaaccagacagaccgcacgggcgagaccgccttgcacctggccgcccgctactcacgctctgatgccgccaagcgcctgctggaggccagcgcagatgccaacatccaggacaacatgggccgcaccccgctgcatgcggctgtgtctgccgacgcacaaggtgtcttccagatcctgatccggaaccgagccacagacctggatgcccgcatgcatgatggcacgacgccactgatcctggctgcccgcctggccgtggagggcatgctggaggacctcatcaactcacacgccgacgtcaacgccgtagatgacctgggcaagtccgccctgcactgggccgccgccgtgaacaatgtggatgccgcagttgtgctcctgaagaacggggctaacaaagatatgcagaacaacagggaggagacacccctgtttctggccgcccgggagggcagctacgagaccgccaaggtgctgctggaccactttgccaaccgggacatcacggatcatatggaccgcctgccgcgcgacatcgcacaggagcgcatgcatcacgacatcgtgaggctgctggacgagtacaacctggtgcgcagcccgcagctgcacggagccccgctggggggcacgcccaccctgtcgcccccgctctgctcgcccaacggctacctgggcagcctcaagcccggcgtgcagggcaagaaggtccgcaagcccagcagcaaaggcctggcctgtggaagcaaggaggccaaggacctcaaggcacggaggaagaagtcccaggacggcaagggctgcctgctggacagctccggcatgctctcgcccgtggactccctggagtcaccccatggctacctgtcagacgtggcctcgccgccactgctgccctccccgttccagcagtctccgtccgtgcccctcaaccacctgcctgggatgcccgacacccacctgggcatcgggcacctgaacgtggcggccaagcccgagatggcggcgctgggtgggggcggccggctggcctttgagactggcccacctcgtctctcccacctgcctgtggcctctggcaccagcaccgtcctgggctccagcagcggaggggccctgaatttcactgtgggcgggtccaccagtttgaatggtcaatgcgagtggctgtcccggctgcagagcggcatggtgccgaaccaatacaaccctctgcgggggagtgtggcaccaggccccctgagcacacaggccccctccctgcagcatggcatggtaggcccgctgcacagtagccttgctgccagcgccctgtcccagatgatgagctaccagggcctgcccagcacccggctggccacccagcctcacctggtgcagacccagcaggtgcagccacaaaacttacagatgcagcagcagaacctgcagccagcaaacatccagcagcagcaaagcctgcagccgccaccaccaccaccacagccgcaccttggcgtgagctcagcagccagcggccacctgggccggagcttcctgagtggagagccgagccaggcagacgtgcagccactgggccccagcagcctggcggtgcacactattctgccccaggagagccccgccctgcccacgtcgctgccatcctcgctggtcccacccgtgaccgcagcccagttcctgacgcccccctcgcagcacagctactcctcgcctgtggacaacacccccagccaccagctacaggtgcctgagcaccccttcctcaccccgtcccctgagtcccctgaccagtggtccagctcgtccccgcattccaacgtctccgactggtccgagggcgtctccagccctcccaccagcatgcagtcccagatcgcccgcattccggaggccttcaagtaa

SEQ ID NO: 73 - DNA, 6966 bp, Homo sapiens
atggggccgggggcccgtggccgccgccgccgccgtcgcccgatgtcgccgccaccgccaccgccacccgtgcgggcgctgcccctgctgctgctgctagcggggccgggggctgcagcccccccttgcctggacggaagcccgtgtgcaaatggaggtcgttgcacccagctgccctcccgggaggctgcctgcctgtgcccgcctggctgggtgggtgagcggtgtcagctggaggacccctgtcactcaggcccctgtgctggccgtggtgtctgccagagttcagtggtggctggcaccgcccgattctcatgccggtgcccccgtggcttccgaggccctgactgctccctgccagatccctgcctcagcagcccttgtgcccacggtgcccgctgctcagtggggcccgatggacgcttcctctgctcctgcccacctggctaccagggccgcagctgccgaagcgacgtggatgagtgccgggtgggtgagccctgccgccatggtggcacctgcctcaacacacctggctccttccgctgccagtgtccagctggctacacagggccactatgtgagaaccccgcggtgccctgtgcaccctcaccatgccgtaacgggggcacctgcaggcagagtggcgacctcacttacgactgtgcctgtcttcctgggtttgagggtcagaattgtgaagtgaacgtggacgactgtccaggacaccgatgtctcaatggggggacatgcgtggatggcgtcaacacctataactgccagtgccctcctgagtggacaggccagttctgcacggaggacgtggatgagtgtcagctgcagcccaacgcctgccacaatgggggtacctgcttcaacacgctgggtggccacagctgcgtgtgtgtcaatggctggacaggcgagagctgcagtcagaatatcgatgactgtgccacagccgtgtgcttccatggggccacctgccatgaccgcgtggcttctttctactgtgcctgccccatgggcaagactggcctcctgtgtcacctggatgacgcctgtgtcagcaacccctgccacgaggatgctatctgtgacacaaatccggtgaacggccgggccatttgcacctgtcctcccggcttcacgggtggggcatgtgaccaggatgtggacgagtgctctatcggcgccaacccctgcgagcacttgggcaggtgcgtgaacacgcagggctccttcctgtgccagtgcggtcgtggctacactggacctcgctgtgagaccgatgtcaacgagtgtctgtcggggccctgccgaaaccaggccacgtgcctcgaccgcataggccagttcacctgtatctgtatggcaggcttcacaggaacctattgcgaggtggacattgacgagtgtcagagtagcccctgtgtcaacggtggggtctgcaaggaccgagtcaatggcttcagctgcacctgcccctcgggcttcagcggctccacgtgtcagctggacgtggacgaatgcgccagcacgccctgcaggaatggcgccaaatgcgtggaccagcccgatggctacgagtgccgctgtgccgagggctttgagggcacgctgtgtgatcgcaacgtggacgactgctcccctgacccatgccaccatggtcgctgcgtggatggcatcgccagcttctcatgtgcctgtgctcctggctacacgggcacacgctgcgagagccaggtggacgaatgccgcagccagccctgccgccatggcggcaaatgcctagacctggtggacaagtacctctgccgctgcccttctgggaccacaggtgtgaactgcgaagtgaacattgacgactgtgccagcaacccctgcacctttggagtctgccgtgatggcatcaaccgctacgactgtgtctgccaacctggcttcacagggcccctttgtaacgtggagatcaatgagtgtgcttccagcccatgcggcgagggaggttcctgtgtggatggggaaaatggcttccgctgcctctgcccgcctggctccttgcccccactctgcctccccccgagccatccctgtgcccatgagccctgcagtcacggcatctgctatgatgcacctggcgggttccgctgtgtgtgtgagcctggctggagtggcccccgctgcagccagagcctggcccgagacgcctgtgagtcccagccgtgcagggccggtgggacatgcagcagcgatggaatgggtttccactgcacctgcccgcctggtgtccagggacgtcagtgtgaactcctctccccctgcaccccgaacccctgtgagcatgggggccgctgcgagtctgcccctggccagctgcctgtctgctcctgcccccagggctggcaaggcccacgatgccagcaggatgtggacgagtgtgctggccccgcaccctgtggccctcatggtatctgcaccaacctggcagggagtttcagctgcacctgccatggagggtacactggcccttcctgcgatcaggacatcaatgactgtgaccccaacccatgcctgaacggtggctcgtgccaagacggcgtgggctccttttcctgctcctgcctccctggtttcgccggcccacgatgcgcccgcgatgtggatgagtgcctgagcaacccctgcggcccgggcacctgtaccgaccacgtggcctccttcacctgcacctgcccgccaggctacggaggcttccactgcgaacaggacctgcccgactgcagccccagctcctgcttcaatggcgggacctgtgtggacggcgtgaactcgttcagctgcctgtgccgtcccggctacacaggagcccactgccaacatgaggcagacccctgcctctcgcggccctgcctacacgggggcgtctgcagcgccgcccaccctggcttccgctgcacctgcctcgagagcttcacgggcccgcagtgccagacgctggtggattggtgcagccgccagccttgtcaaaacgggggtcgctgcgtccagactggggcctattgcctttgtccccctggatggagcggacgcctctgtgacatccgaagcttgccctgcagggaggccgcagcccagatcggggtgcggctggagcagctgtgtcaggcgggtgggcagtgtgtggatgaagacagctcccactactgcgtgtgcccagagggccgtactggtagccactgtgagcaggaggtggacccctgcttggcccagccctgccagcatggggggacctgccgtggctatatggggggctacatgtgtgagtgtcttcctggctacaatggtgataactgtgaggacgacgtggacgagtgtgcctcccagccctgccagcacgggggttcatgcattgacctcgtggcccgctatctctgctcctgtcccccaggaacgctgggggtgctctgcgagattaatgaggatgactgcggcccaggcccaccgctggactcagggccccggtgcctacacaatggcacctgcgtggacctggtgggtggtttccgctgcacctgtcccccaggatacactggtttgcgctgcgaggcagacatcaatgagtgtcgctcaggtgcctgccacgcggcacacacccgggactgcctgcaggacccaggcggaggtttccgttgcctttgtcatgctggcttctcaggtcctcgctgtcagactgtcctgtctccctgcgagtcccagccatgccagcatggaggccagtgccgtcctagcccgggtcctgggggtgggctgaccttcacctgtcactgtgcccagccgttctggggtccgcgttgcgagcgggtggcgcgctcctgccgggagctgcagtgcccggtgggcgtcccatgccagcagacgccccgcgggccgcgctgcgcctgccccccagggttgtcgggaccctcctgccgcagcttcccggggtcgccgccgggggccagcaacgccagctgcgcggccgccccctgtctccacgggggctcctgccgccccgcgccgctcgcgcccttcttccgctgcgcttgcgcgcagggctggaccgggccgcgctgcgaggcgcccgccgcggcacccgaggtctcggaggagccgcggtgcccgcgcgccgcctgccaggccaagcgcggggaccagcgctgcgaccgcgagtgcaacagcccaggctgcggctgggacggcggcgactgctcgctgagcgtgggcgacccctggcggcaatgcgaggcgctgcagtgctggcgcctcttcaacaacagccgctgcgaccccgcctgcagctcgcccgcctgcctctacgacaacttcgactgccacgccggtggccgcgagcgcacttgcaacccggtgtacgagaagtactgcgccgaccactttgccgacggccgctgcgaccagggctgcaacacggaggagtgcggctgggatgggctggattgtgccagcgaggtgccggccctgctggcccgcggcgtgctggtgctcacagtgctgctgccgccagaggagctactgcgttccagcgccgactttctgcagcggctcagcgccatcctgcgcacctcgctgcgcttccgcctggacgcgcacggccaggccatggtcttcccttaccaccggcctagtcctggctccgaaccccgggcccgtcgggagctggcccccgaggtgatcggctcggtagtaatgctggagattgacaaccggctctgcctgcagtcgcctgagaatgatcactgcttccccgatgcccagagcgccgctgactacctgggagcgttgtcagcggtggagcgcctggacttcccgtacccactgcgggacgtgcggggggagccgctggagcctccagaacccagcgtcccgctgctgccactgctagtggcgggcgctgtcttgctgctggtcattctcgtcctgggtgtcatggtggcccggcgcaagcgcgagcacagcaccctctggttccctgagggcttctcactgcacaaggacgtggcctctggtcacaagggccggcgggaacccgtgggccaggacgcgctgggcatgaagaacatggccaagggtgagagcctgatgggggaggtggccacagactggatggacacagagtgcccagaggccaagcggctaaaggtagaggagccaggcatgggggctgaggaggctgtggattgccgtcagtggactcaacaccatctggttgctgctgacatccgcgtggcaccagccatggcactgacaccaccacagggcgacgcagatgctgatggcatggatgtcaatgtgcgtggcccagatggcttcaccccgctaatgctggcttccttctgtgggggggctctggagccaatgccaactgaagaggatgaggcagatgacacatcagctagcatcatctccgacctgatctgccagggggctcagcttggggcacggactgaccgtactggcgagactgctttgcacctggctgcccgttatgcccgtgctgatgcagccaagcggctgctggatgctggggcagacaccaatgcccaggaccactcaggccgcactcccctgcacacagctgtcacagccgatgcccagggtgtcttccagattctcatccgaaaccgctctacagacttggatgcccgcatggcagatggctcaacggcactgatcctggcggcccgcctggcagtagagggcatggtggaagagctcatcgccagccatgctgatgtcaatgctgtggatgagcttgggaaatcagccttacactgggctgcggctgtgaacaacgtggaagccactttggccctgctcaaaaatggagccaataaggacatgcaggatagcaaggaggagacccccctattcctggccgcccgcgagggcagctatgaggctgccaagctgctgttggaccactttgccaaccgtgagatcaccgaccacctggacaggctgccgcgggacgtagcccaggagagactgcaccaggacatcgtgcgcttgctggatcaacccagtgggccccgcagcccccccggtccccacggcctggggcctctgctctgtcctccaggggccttcctccctggcctcaaagcggcacagtcggggtccaagaagagcaggaggccccccgggaaggcggggctggggccgcaggggccccgggggcggggcaagaagctgacgctggcctgcccgggccccctggctgacagctcggtcacgctgtcgcccgtggactcgctggactccccgcggcctttcggtgggccccctgcttcccctggtggcttcccccttgaggggccctatgcagctgccactgccactgcagtgtctctggcacagcttggtggcccaggccgggcgggtctagggcgccagccccctggaggatgtgtactcagcctgggcctgctgaaccctgtggctgtgcccctcgattgggcccggctgcccccacctgcccctccaggcccctcgttcctgctgccactggcgccgggaccccagctgctcaacccagggacccccgtctccccgcaggagcggcccccgccttacctggcagtcccaggacatggcgaggagtacccggcggctggggcacacagcagccccccaaaggcccgcttcctgcgggttcccagtgagcacccttacctgaccccatcccccgaatcccctgagcactgggccagcccctcacctccctccctctcagactggtccgaatccacgcctagcccagccactgccactggggccatggccaccaccactggggcactgcctgcccagccacttcccttgtctgttcccagctcccttgctcaggcccagacccagctggggccccagccggaagttacccccaagaggcaagtgttggcctga

SEQ ID NO: 74 - DNA, 1797 bp, Homo sapiens
atgccttgtgttcaggcgcagtatgggtcctcgcctcaaggagccagccccgcttctcagagctacagttaccactcttcgggagaatacagctccgatttcttaactccagagtttgtcaagtttagcatggacctcaccaacactgaaatcactgccaccacttctctccccagcttcagtacctttatggacaactacagcacaggctacgacgtcaagccaccttgcttgtaccaaatgcccctgtccggacagcagtcctccattaaggtagaagacattcagatgcacaactaccagcaacacagccacctgcccccccagtctgaggagatgatgccgcactccgggtcggtttactacaagccctcctcgcccccgacgcccaccaccccgggcttccaggtgcagcacagccccatgtgggacgacccgggatctctccacaacttccaccagaactacgtggccactacgcacatgatcgagcagaggaaaacgccagtctcccgcctctccctcttctcctttaagcaatcgccccctggcaccccggtgtctagttgccagatgcgcttcgacgggcccctgcacgtccccatgaacccggagcccgccggcagccaccacgtggtggacgggcagaccttcgctgtgcccaaccccattcgcaagcccgcgtccatgggcttcccgggcctgcagatcggccacgcgtctcagctgctcgacacgcaggtgccctcaccgccgtcgcggggctccccctccaacgaggggctgtgcgctgtgtgtggggacaacgcggcctgccaacactacggcgtgcgcacctgtgagggctgcaaaggcttctttaagcgcacagtgcaaaaaaatgcaaaatacgtgtgtttagcaaataaaaactgcccagtggacaagcgtcgccggaatcgctgtcagtactgccgatttcagaagtgcctggctgttgggatggtcaaagaagtggttcgcacagacagtttaaaaggccggagaggtcgtttgccctcgaaaccgaagagcccacaggagccctctcccccttcgcccccggtgagtctgatcagtgccctcgtcagggcccatgtcgactccaacccggctatgaccagcctggactattccaggttccaggcgaaccctgactatcaaatgagtggagatgacacccagcatatccagcaattctatgatctcctgactggctccatggagatcatccggggctgggcagagaagatccctggcttcgcagacctgcccaaagccgaccaagacctgctttttgaatcagctttcttagaactgtttgtccttcgattagcatacaggtccaacccagtggagggtaaactcatcttttgcaatggggtggtcttgcacaggttgcaatgcgttcgtggctttggggaatggattgattccattgttgaattctcctccaacttgcagaatatgaacatcgacatttctgccttctcctgcattgctgccctggctatggtcacagagagacacgggctcaaggaacccaagagagtggaagaactgcaaaacaagattgtaaattgtctcaaagaccacgtgactttcaacaatggggggttgaaccgccccaattatttgtccaaactgttggggaagctcccagaacttcgtaccctttgcacacaggggctacagcgcattttctacctgaaattggaagacttggtgccaccgccagcaataattgacaaacttttcctggacactttacctttctaa

SEQ ID NO: 75 - DNA, 1074 bp, Homo sapiens
atgcagagtgtgcagagcacgagcttttgtctccgaaagcagtgcctttgcctgaccttcctgcttctccatctcctgggacaggtcgctgcgactcagcgctgccctccccagtgcccgggccggtgccctgcgacgccgccgacctgcgcccccggggtgcgcgcggtgctggacggctgctcatgctgtctggtgtgtgcccgccagcgtggcgagagctgctcagatctggagccatgcgacgagagcagtggcctctactgtgatcgcagcgcggaccccagcaaccagactggcatctgcacggcggtagagggagataactgtgtgttcgatggggtcatctaccgcagtggagagaaatttcagccaagctgcaaattccagtgcacctgcagagatgggcagattggctgtgtgccccgctgtcagctggatgtgctactgcctgagcctaactgcccagctccaagaaaagttgaggtgcctggagagtgctgtgaaaagtggatctgtggcccagatgaggaggattcactgggaggccttacccttgcagcttacaggccagaagccaccctaggagtagaagtctctgactcaagtgtcaactgcattgaacagaccacagagtggacagcatgctccaagagctgtggtatggggttctccacccgggtcaccaataggaaccgtcaatgtgagatgctgaaacagactcggctctgcatggtgcggccctgtgaacaagagccagagcagccaacagataagaaaggaaaaaagtgtctccgcaccaagaagtcactcaaagccatccacctgcagttcaagaactgcaccagcctgcacacctacaagcccaggttctgtggggtctgcagtgatggccgctgctgcactccccacaataccaaaaccatccaggcagagtttcagtgctccccagggcaaatagtcaagaagccagtgatggtcattgggacctgcacctgtcacaccaactgtcctaagaacaatgaggccttcctccaggagctggagctgaagactaccagagggaaaatgtaa

SEQ ID NO: 76 - DNA, 768 bp, Homo sapiens
atgctgcggccacagcggcccggagacttgcagctcggggcctccctctacgagctggtgggctacaggcagccgccctcctcctcctcctcctccacctcctccacctcctccacttcctcctcctccacgacggcccccctcctccccaaggctgcgcgcgagaagccggaggcgccggccgagcctccaggccccgggcccgggtcaggcgcgcacccgggcggcagcgcccggccggacgccaaggaggagcagcagcagcagctgcggcgcaagatcaacagccgcgagcggaagcgcatgcaggacctgaacctggccatggacgccctgcgcgaggtcatcctgccctactcagcggcgcactgccagggcgcgcccggccgcaagctctccaagatagccacgctgctgctcgcccgcaactacatcctactgctgggcagctcgctgcaggagctgcgccgcgcgctgggcgagggcgccgggcccgccgcgccgcgcctgctgctggccgggctgcccctgctcgccgccgcgcccggctccgtgttgctggcgcccggcgccgtaggaccccccgacgcgctgcgccccgccaagtacctgtcgctggcgctggacgagccgccgtgcggccagttcgctctccccggcggcggcgcaggcggccccggcctctgcacctgcgccgtgtgcaagttcccgcacctggtcccggccagcctgggcctggccgccgtgcaggcgcaattctccaagtga

SEQ ID NO: 77 - DNA, 972 bp, Homo sapiens
atggactcggacgccagcctggtgtccagccgcccgtcgtcgccagagcccgatgacctttttctgccggcccggagtaagggcagcagcggcagcgccttcactgggggcaccgtgtcctcgtccaccccgagtgactgcccgccggagctgagcgccgagctgcgcggcgctatgggctctgcgggcgcgcatcctggggacaagctaggaggcagtggcttcaagtcatcctcgtccagcacctcgtcgtctacgtcgtcggcggctgcgtcgtccaccaagaaggacaagaagcaaatgacagagccggagctgcagcagctgcgtctcaagatcaacagccgcgagcgcaagcgcatgcacgacctcaacatcgccatggatggcctccgcgaggtcatgccgtacgcacacggcccttcggtgcgcaagctttccaagatcgccacgctgctgctggcgcgcaactacatcctcatgctcaccaactcgctggaggagatgaagcgactggtgagcgagatctacgggggccaccacgctggcttccacccgtcggcctgcggcggcctggcgcactccgcgcccctgcccgccgccaccgcgcacccggcagcagcagcgcacgccgcacatcaccccgcggtgcaccaccccatcctgccgcccgccgccgcagcggctgctgccgccgctgcagccgcggctgtgtccagcgcctctctgcccggatccgggctgccgtcggtcggctccatccgtccaccgcacggcctactcaagtctccgtctgctgccgcggccgccccgctggggggcgggggcggcggcagtggggcgagcgggggcttccagcactggggcggcatgccctgcccctgcagcatgtgccaggtgccgccgccgcaccaccacgtgtcggctatgggcgccggcagcctgccgcgcctcacctccgacgccaagtga

SEQ ID NO: 78 - DNA, 852 bp, Homo sapiens
atgaacggcgaggagcagtactacgcggccacgcagctttacaaggacccatgcgcgttccagcgaggcccggcgccggagttcagcgccagcccccctgcgtgcctgtacatgggccgccagcccccgccgccgccgccgcacccgttccctggcgccctgggcgcgctggagcagggcagccccccggacatctccccgtacgaggtgccccccctcgccgacgaccccgcggtggcgcaccttcaccaccacctcccggctcagctcgcgctcccccacccgcccgccgggcccttcccggagggagccgagccgggcgtcctggaggagcccaaccgcgtccagctgcctttcccatggatgaagtctaccaaagctcacgcgtggaaaggccagtgggcaggcggcgcctacgctgcggagccggaggagaacaagcggacgcgcacggcctacacgcgcgcacagctgctagagctggagaaggagttcctattcaacaagtacatctcacggccgcgccgggtggagctggctgtcatgttgaacttgaccgagagacacatcaagatctggttccaaaaccgccgcatgaagtggaaaaaggaggaggacaagaagcgcggcggcgggacagctgtcgggggtggcggggtcgcggagcctgagcaggactgcgccgtgacctccggcgaggagcttctggcgctgccgccgccgccgccccccggaggtgctgtgccgcccgctgcccccgttgccgcccgagagggccgcctgccgcctggccttagcgcgtcgccacagccctccagcgtcgcgcctcggcggccgcaggaaccacgatga

SEQ ID NO: 79 - DNA, 717 bp, Homo sapiens
atgagacagagcggcgcctcccagcccctgctgatcaacatgtacctgccagatcccgtcggagacggtctcttcaaggacgggaagaacccgagctgggggccgctgagccccgcggttcagaaaggcagcggacagatccagctgtggcagtttctgctggagctgctggctgaccgcgcgaacgccggctgcatcgcgtgggagggcggtcacggcgagttcaagctcacggacccggacgaggtggcgcggcggtggggcgagcgcaagagcaagcccaacatgaactacgacaagctgagccgcgccctgcgctactactacgacaagaacatcatgagcaaggtgcatggcaagcgctacgcctaccgcttcgacttccagggcctggcgcaggcctgccagccgccgcccgcgcacgctcatgccgccgccgcagctgctgccgccgccgcggccgcccaggacggcgcgctctacaagctgcccgccggcctcgccccgctgcccttccccggcctctccaaactcaacctcatggccgcctcggccggggtcgcgcccgccggcttctcctactggccgggcccgggccccgccgccaccgctgccgccgccaccgccgcgctctaccccagtcccagcttgcagcccccgcccgggcccttcggggccgtggccgcagcctcgcacttggggggccattaccactag

SEQ ID NO: 80 - DNA, 855 bp, Homo sapiens
atggactactcctacctcaattcgtacgactcgtgcgtggcggccatggaggcgtccgcctacggcgactttggcgcctgcagccagcccggcggcttccaatacagccccctgcggcccgctttccccgcggcagggccgccctgccccgcgctcggctcctccaactgcgcacttggcgccctacgcgaccaccagcccgcgccctactcggcagtgccctacaagttcttcccagagccatccggcctgcacgagaagcgcaagcagcggcgcatccgcaccacgttcaccagcgcgcagctcaaggagctggagcgcgttttcgctgagacccactaccccgacatttacacgcgtgaggagctggcgctcaagatcgacctcactgaggctcgcgtgcaggtctggttccagaaccgccgggccaagttccgcaaacaggagcgcgcggccagcgccaagggcgcggcgggcgcggcgggcgccaaaaagggcgaggcgcgctgctcctccgaggacgacgattccaaggagtccacgtgcagccccacgcccgatagcaccgcctcgctgccgccgccgcctgcgcccggcctggccagcccgcgcctgagccccagcccgctgcccgtcgcactgggctccgggccgggacctgggccggggccacagccgctcaagggcgcactgtgggccggtgtggcgggcggtgggggcggcgggcctggcgcgggagcggccgaactacttaaggcttggcagccggcggagtccggccccgggcccttctccggggttctgtcctcctttcaccggaagcccggccccgccctgaagaccaatctcttctag

SEQ ID NO: 81 - DNA, 945 bp, Homo sapiens
atgtataaaatggaatattcttacctcaattcctctgcctacgagtcctgtatggctgggatggacacctcgagcctggcttcagcctatgctgacttcagttcctgcagccaggccagtggcttccagtataacccgataaggaccacttttggggccacgtccggctgcccttccctcacgccgggatcctgcagcctgggcaccctcagggaccaccagagcagtccgtacgccgcagttccttacaaactcttcacggaccacggcggcctcaacgagaagcgcaagcagcggcgcatccgcaccactttcaccagtgcccagctcaaagagctggaaagggtcttcgcggagactcactaccccgacatctacactcgggaggagctggccctgaagatcgacctcacagaggcgcgagtccaggtgtggttccagaaccgccgcgccaagtttcgcaagcaggagcgcgcagcggcagccgcagcggccgcggccaagaacggctcctcgggcaaaaagtctgactcttccagggacgacgagagcaaagaggccaagagcactgacccggacagcactgggggcccaggtcccaatcccaaccccacccccagctgcggggcgaatggaggcggcggcggcgggcccagcccggctggagctccgggggcggcggggcccgggggcccgggaggcgaacccggcaagggcggcgcagcagcagcggcggcggccgcggcagcggcggcggcggcagcggcagcggcggcagctggaggcctggctgcggctgggggccctggacaaggctgggctcccggccccggccccatcacctccatcccggattcgcttgggggtcccttcgccagcgtcctatcttcgctccaaagacccaacggtgccaaagccgccttagtgaagagcagtatgttctga

SEQ ID NO: 82 - DNA, 876 bp, Homo sapiens
atgagttgccaagcttttacttcggctgatacctttatacctctgaattctgacgcctctgcaactctgcctctgataatgcatcacagtgctgccgagtgtctaccagtctccaaccatgccaccaatgtgatgtctacagcaacaggacttcattattctgttccttcctgtcattatggaaaccagccatcaacctatggagtgatggcaggtagtttaaccccttgtctttataaatttcctgaccacaccttgagtcatggatttcctcctatacaccagcctcttctggcagaggaccccacagctgctgatttcaagcaggaactcaggcggaaaagtaaattggtggaagagccaatagacatggattctccagaaatcagagaacttgaaaagtttgccaatgaatttaaagtgagacgaattaaattaggatacacccagacaaatgttggggaggccctggcagctgtgcatggctctgaattcagtcaaacaacaatctgccgatttgaaaatctgcagctcagctttaaaaatgcatgcaaactgaaagcaatattatccaaatggctggaggaagctgagcaagtaggagctttgtacaatgaaaaagtgggagcaaatgaaaggaaaagaaaacgaagaacaactataagcattgctgctaaagatgctctggagagacactttggagaacagaataaaccttcttctcaagagatcatgaggatggctgaagaactgaatctggagaaagaagtagtaagagtttggttttgcaaccggaggcagagagaaaaacgggtgaaaacaagtctgaatcagagtttattttctatttctaaggaacatcttgagtgcagataa

SEQ ID NO: 83 - DNA, 909 bp, Homo sapiens
atggagttcggcctgctcagcgaggcagaggcccggagccctgccctgtcgctgtcagacgctggcactccgcacccccagctcccagagcacggctgcaagggccaggagcacagcgactcagaaaaggcctcggcttcgctgcccggcggctccccagaggacggttcgctgaaaaagaagcagcggcggcagcgcacgcacttcaccagccagcagctacaggagctagaggcgaccttccagaggaaccgctaccccgacatgagcacgcgcgaggagatcgccgtgtggaccaacctcaccgaggcccgcgtgcgggtgtggttcaagaaccggcgcgccaaatggcggaagcgcgagcgcagccagcaggccgagctatgcaaaggcagcttcgcggcgccgctcggggggctggtgccgccctacgaggaggtgtaccccggctactcgtacggcaactggccgcccaaggctcttgccccgccgctcgccgccaagacctttccattcgccttcaactcggtcaacgtggggcctctggcttcgcagcccgtcttctcgccacccagctccatcgccgcctccatggtgccctccgccgcggctgccccgggcaccgtgccagggcctggggccctgcagggcctgggcgggggcccccccgggctggctccggccgccgtgtcctccggggccgtgtcctgcccttatgcctcggccgccgccgccgccgcggctgccgcctcttccccctacgtctatcgggacccgtgtaactcgagcctggccagcctgcggctcaaagccaaacagcacgcctccttcagctaccccgctgtgcacgggccgcccccggcagccaaccttagtccgtgccagtacgccgtggaaaggcccgtatga

SEQ ID NO: 84 - DNA, 1362 bp, Homo sapiens
atgcgtatccccgtagatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaagacatcggcagaaactagatgatcagaccaagcccgggagcttgtccttttccgagcggctcagtgaactggagcagctgcggcgcacagccatgagggtcagcccacaccacccagcccccacgcccaaccctcgtgcctccctgaaccactccactgcctttaaccctcagcctcagagtcagatgcaggatacaaggcagatccaaccatccccaccgtggtcctacgatcagtcctaccaatacctgggatccattgcctctccttctgtgcacccagcaacgcccatttcacctggacgtgccagcggcatgacaaccctctctgcagaactttccagtcgactctcaacggcacccgacctgacagcgttcagcgacccgcgccagttccccgcgctgccctccatctccgacccccgcatgcactatccaggcgccttcacctactccccgacgccggtcacctcgggcatcggcatcggcatgtcggccatgggctcggccacgcgctaccacacctacctgccgccgccctaccccggctcgtcgcaagcgcagggaggcccgttccaagccagctcgccctcctaccacctgtactacggcgcctcggccggctcctaccagttctccatggtgggcggcgagcgctcgccgccgcgcatcctgccgccctgcaccaacgcctccaccggctccgcgctgctcaaccccagcctcccgaaccagagcgacgtggtggaggccgagggcagccacagcaactcccccaccaacatggcgccctccgcgcgcctggaggaggccgtgtggaggccctactga

SEQ ID NO: 85 - DNA, 1704 bp, Homo sapiens
atgcttcattcgcctcacaaacaaccacagaaccacaagtgcggtgcaaactttctccaggaggacagcaagaagtctctggtttttaaatggttaatctccgcaggtcactaccagccaccgagaccaacagagtcatttaaggctgcaagcagtatttacaacagagggtacaagttctatctgaaaaaaaaaggagggactatggcatcaaacagcctcttcagcacagtgacaccatgtcagcaaaacttcttttgggatccgagcaccagccggcgcttcagccccccctccagcagcctgcagcccggcaaaatgagcgacgtgagcccggtggtggctgcgcaacagcagcagcaacagcagcagcagcaacagcagcagcagcagcagcaacagcagcagcagcagcaggaggcggcggcggcggctgcggcggcggcggcggctgcggcggcggcagctgcagtgccccggttgcggccgccccacgacaaccgcaccatggtggagatcatcgccgaccacccggccgaactcgtccgcaccgacagccccaacttcctgtgctcggtgctgccctcgcactggcgctgcaacaagaccctgcccgtggccttcaaggtggtagccctcggagaggtaccagatgggactgtggttactgtcatggcgggtaacgatgaaaattattctgctgagctccggaatgcctctgctgttatgaaaaaccaagtagcaaggttcaacgatctgagatttgtgggccggagtggacgaggcaagagtttcaccttgaccataaccgtcttcacaaatcctccccaagtagctacctatcacagagcaattaaagttacagtagatggacctcgggaacccagaaggcacagacagaagcttgatgactctaaacctagtttgttctctgaccgcctcagtgatttagggcgcattcctcatcccagtatgagagtaggtgtcccgcctcagaacccacggccctccctgaactctgcaccaagtccttttaatccacaaggacagagtcagattacagaccccaggcaggcacagtcttccccgccgtggtcctatgaccagtcttacccctcctacctgagccagatgacgtccccgtccatccactctaccaccccgctgtcttccacacggggcactgggcttcctgccatcaccgatgtgcctaggcgcatttcaggtgcttcagaactgggccctttttcagaccccaggcagttcccaagcatttcatccctcactgagagccgcttctccaacccacgaatgcactatccagccacctttacttacaccccgccagtcacctcaggcatgtccctcggtatgtccgccaccactcactaccacacctacctgccaccaccctaccccggctcttcccaaagccagagtggacccttccagaccagcagcactccatatctctactatggcacttcgtcaggatcctatcagtttcccatggtgccggggggagaccggtctccttccagaatgcttccgccatgcaccaccacctcgaatggcagcacgctattaaatccaaatttgcctaaccagaatgatggtgttgacgctgatggaagccacagcagttccccaactgttttgaattctagtggcagaatggatgaatctgtttggcgaccatattga

SEQ ID NO: 86 - DNA, 1389 bp, Homo sapiens
atgctgctgctggcgagatgtctgctgctagtcctcgtctcctcgctgctggtatgctcgggactggcgtgcggaccgggcagggggttcgggaagaggaggcaccccaaaaagctgacccctttagcctacaagcagtttatccccaatgtggccgagaagaccctaggcgccagcggaaggtatgaagggaagatctccagaaactccgagcgatttaaggaactcacccccaattacaaccccgacatcatatttaaggatgaagaaaacaccggagcggacaggctgatgactcagaggtgtaaggacaagttgaacgctttggccatctcggtgatgaaccagtggccaggagtgaaactgcgggtgaccgagggctgggacgaagatggccaccactcagaggagtctctgcactacgagggccgcgcagtggacatcaccacgtctgaccgcgaccgcagcaagtacggcatgctggcccgcctggcggtggaggccggcttcgactgggtgtactacgagtccaaggcacatatccactgctcggtgaaagcagagaactcggtggcggccaaatcgggaggctgcttcccgggctcggccacggtgcacctggagcagggcggcaccaagctggtgaaggacctgagccccggggaccgcgtgctggcggcggacgaccagggccggctgctctacagcgacttcctcactttcctggaccgcgacgacggcgccaagaaggtcttctacgtgatcgagacgcgggagccgcgcgagcgcctgctgctcaccgccgcgcacctgctctttgtggcgccgcacaacgactcggccaccggggagcccgaggcgtcctcgggctcggggccgccttccgggggcgcactggggcctcgggcgctgttcgccagccgcgtgcgcccgggccagcgcgtgtacgtggtggccgagcgtgacggggaccgccggctcctgcccgccgctgtgcacagcgtgaccctaagcgaggaggccgcgggcgcctacgcgccgctcacggcccagggcaccattctcatcaaccgggtgctggcctcgtgctacgcggtcatcgaggagcacagctgggcgcaccgggccttcgcgcccttccgcctggcgcacgcgctcctggctgcactggcgcccgcgcgcacggaccgcggcggggacagcggcggcggggaccgcgggggcggcggcggcagagtagccctaaccgctccaggtgctgccgacgctccgggtgcgggggccaccgcgggcatccactggtactcgcagctgctctaccaaataggcacctggctcctggacagcgaggccctgcacccgctgggcatggcggtcaagtccagctga

SEQ ID NO: 87 - DNA, 1530 bp, Homo sapiens
atgaatctcctggaccccttcatgaagatgaccgacgagcaggagaagggcctgtccggcgcccccagccccaccatgtccgaggactccgcgggctcgccctgcccgtcgggctccggctcggacaccgagaacacgcggccccaggagaacacgttccccaagggcgagcccgatctgaagaaggagagcgaggaggacaagttccccgtgtgcatccgcgaggcggtcagccaggtgctcaaaggctacgactggacgctggtgcccatgccggtgcgcgtcaacggctccagcaagaacaagccgcacgtcaagcggcccatgaacgccttcatggtgtgggcgcaggcggcgcgcaggaagctcgcggaccagtacccgcacttgcacaacgccgagctcagcaagacgctgggcaagctctggagacttctgaacgagagcgagaagcggcccttcgtggaggaggcggagcggctgcgcgtgcagcacaagaaggaccacccggattacaagtaccagccgcggcggaggaagtcggtgaagaacgggcaggcggaggcagaggaggccacggagcagacgcacatctcccccaacgccatcttcaaggcgctgcaggccgactcgccacactcctcctccggcatgagcgaggtgcactcccccggcgagcactcggggcaatcccagggcccaccgaccccacccaccacccccaaaaccgacgtgcagccgggcaaggctgacctgaagcgagaggggcgccccttgccagaggggggcagacagccccctatcgacttccgcgacgtggacatcggcgagctgagcagcgacgtcatctccaacatcgagaccttcgatgtcaacgagtttgaccagtacctgccgcccaacggccacccgggggtgccggccacgcacggccaggtcacctacacgggcagctacggcatcagcagcaccgcggccaccccggcgagcgcgggccacgtgtggatgtccaagcagcaggcgccgccgccacccccgcagcagcccccacaggccccgccggccccgcaggcgcccccgcagccgcaggcggcgcccccacagcagccggcggcacccccgcagcagccacaggcgcacacgctgaccacgctgagcagcgagccgggccagtcccagcgaacgcacatcaagacggagcagctgagccccagccactacagcgagcagcagcagcactcgccccaacagatcgcctacagccccttcaacctcccacactacagcccctcctacccgcccatcacccgctcacagtacgactacaccgaccaccagaactccagctcctactacagccacgcggcaggccagggcaccggcctctactccaccttcacctacatgaaccccgctcagcgccccatgtacacccccatcgccgacacctctggggtcccttccatcccgcagacccacagcccccagcactgggaacaacccgtctacacacagctcactcgaccttga

SEQ ID NO: 88 - DNA, 1245 bp, Homo sapiens
atgagcagcccggatgcgggatacgccagtgacgaccagagccagacccagagcgcgctgcccgcggtgatggccgggctgggcccctgcccctgggccgagtcgctgagccccatcggggacatgaaggtgaagggcgaggcgccggcgaacagcggagcaccggccggggccgcgggccgagccaagggcgagtcccgtatccggcggccgatgaacgctttcatggtgtgggctaaggacgagcgcaagcggctggcgcagcagaatccagacctgcacaacgccgagttgagcaagatgctgggcaagtcgtggaaggcgctgacgctggcggagaagcggcccttcgtggaggaggcagagcggctgcgcgtgcagcacatgcaggaccaccccaactacaagtaccggccgcggcggcgcaagcaggtgaagcggctgaagcgggtggagggcggcttcctgcacggcctggctgagccgcaggcggccgcgctgggccccgagggcggccgcgtggccatggacggcctgggcctccagttccccgagcagggcttccccgccggcccgccgctgctgcctccgcacatgggcggccactaccgcgactgccagagtctgggcgcgcctccgctcgacggctacccgttgcccacgcccgacacgtccccgctggacggcgtggaccccgacccggctttcttcgccgccccgatgcccggggactgcccggcggccggcacctacagctacgcgcaggtctcggactacgctggccccccggagcctcccgccggtcccatgcacccccgactcggcccagagcccgcgggtccctcgattccgggcctcctggcgccacccagcgcccttcacgtgtactacggcgcgatgggctcgcccggggcgggcggcgggcgcggcttccagatgcagccgcaacaccagcaccagcaccagcaccagcaccaccccccgggccccggacagccgtcgccccctccggaggcactgccctgccgggacggcacggaccccagtcagcccgccgagctcctcggggaggtggaccgcacggaatttgaacagtatctgcacttcgtgtgcaagcctgagatgggcctcccctaccaggggcatgactccggtgtgaatctccccgacagccacggggccatttcctcggtggtgtccgacgccagctccgcggtatattactgcaactatcctgacgtgtga

SEQ ID NO: 89 - DNA, 987 bp, Homo sapiens
atgactggagtctttgacagtctagtggctgatatgcactcgacccagatcgccgcctccagcacgtaccaccagcaccagcagcccccgagcggcggcggcgccggcccgggtggcaacagcagcagcagcagcagcctccacaagccccaggagtcgcccacccttccggtgtccaccgccaccgacagcagctactacaccaaccagcagcacccggcgggcggcggcggcggcgggggctcgccctacgcgcacatgggttcctaccagtaccaagccagcggcctcaacaacgtcccttactccgccaagagcagctatgacctgggctacaccgccgcctacacctcctacgctccctatggaaccagttcgtccccagccaacaacgagcctgagaaggaggaccttgagcctgaaattcggatagtgaacgggaagccaaagaaagtccggaaaccccgcaccatctactccagtttccagctggcggctcttcagcggcgtttccaaaagactcaatacttggccttgccggagcgagccgagctggcggcctctctgggcctcacccagactcaggtcaaaatctggttccagaaccgccggtccaagttcaagaagatgtggaaaagtggtgagatcccctcggagcagcaccctggggccagcgcttctccaccttgtgcttcgccgccagtctcagcgccggcctcctgggactttggtgtgccgcagcggatggcgggcggcggtggtccgggcagtggcggcagcggcgccggcagctcgggctccagcccgagcagcgcggcctcggcttttctgggcaactacccctggtaccaccagacctcgggatccgcctcacacctgcaggccacggcgccgctgctgcaccccactcagaccccgcagccgcatcaccaccaccaccatcacggcggcgggggcgccccggtgagcgcggggacgattttctaa

SEQ ID NO: 90 - DNA, 870 bp, Homo sapiens
atgacaggagtgtttgacagaagggtccccagcatccgatccggcgacttccaagctccgttccagacgtccgcagctatgcaccatccgtctcaggaatcgccaactttgcccgagtcttcagctaccgattctgactactacagccctacggggggagccccgcacggctactgctctcctacctcggcttcctatggcaaagctctcaacccctaccagtatcagtatcacggcgtgaacggctccgccgggagctacccagccaaagcttatgccgactatagctacgctagctcctaccaccagtacggcggcgcctacaaccgcgtcccaagcgccaccaaccagccagagaaagaagtgaccgagcccgaggtgagaatggtgaatggcaaaccaaagaaagttcgtaaacccaggactatttattccagctttcagctggccgcattacagagaaggtttcagaagactcagtacctcgccttgccggaacgcgccgagctggccgcctcgctgggattgacacaaacacaggtgaaaatctggtttcagaacaaaagatccaagatcaagaagatcatgaaaaacggggagatgcccccggagcacagtcccagctccagcgacccaatggcgtgtaactcgccgcagtctccagcggtgtgggagccccagggctcgtcccgctcgctcagccaccaccctcatgcccaccctccgacctccaaccagtccccagcgtccagctacctggagaactctgcatcctggtacacaagtgcagccagctcaatcaattcccacctgccgccgccgggctccttacagcacccgctggcgctggcctccgggacactctattag

SEQ ID NO: 91 - DNA, 843 bp, Homo sapiens
atgccagctgatataatggagaaaaattcctcgtccccggtggctgctaccccagccagtgtcaacacgacaccggataaaccaaagacagcatctgagcacagaaagtcatcaaagcctattatggagaaaagacgaagagcaagaataaatgaaagtctgagccagctgaaaacactgattttggatgctctgaagaaagatagctcgcggcattccaagctggagaaggcggacattctggaaatgacagtgaagcacctccggaacctgcagcgggcgcagatgacggctgcgctgagcacagacccaagtgtgctggggaagtaccgagccggcttcagcgagtgcatgaacgaggtgacccgcttcctgtccacgtgcgagggcgttaataccgaggtgcgcactcggctgctcggccacctggccaactgcatgacccagatcaatgccatgacctaccccgggcagccgcaccccgccttgcaggcgccgccaccgcccccaccgggacccggcggcccccagcacgcgccgttcgcgccgccgccgccactcgtgcccatccccgggggcgcggcgccccctcccggcggcgccccctgcaagctgggcagccaggctggagaggcggctaaggtgtttggaggcttccaggtggtaccggctcccgatggccagtttgctttcctcattcccaacggggccttcgcgcacagcggccctgtcatccccgtctacaccagcaacagcggcacctccgtgggccccaacgcagtgtcaccttccagcggcccctcgcttacggcggactccatgtggaggccgtggcggaactga

SEQ ID NO: 92 - DNA, 648 bp, Homo sapiens
atgggcagcccccgctccgcgctgagctgcctgctgttgcacttgctggtcctctgcctccaagcccaggtaactgttcagtcctcacctaattttacacagcatgtgagggagcagagcctggtgacggatcagctcagccgccgcctcatccggacctaccaactctacagccgcaccagcgggaagcacgtgcaggtcctggccaacaagcgcatcaacgccatggcagaggacggcgaccccttcgcaaagctcatcgtggagacggacacctttggaagcagagttcgagtccgaggagccgagacgggcctctacatctgcatgaacaagaaggggaagctgatcgccaagagcaacggcaaaggcaaggactgcgtcttcacggagattgtgctggagaacaactacacagcgctgcagaatgccaagtacgagggctggtacatggccttcacccgcaagggccggccccgcaagggctccaagacgcggcagcaccagcgtgaggtccacttcatgaagcggctgccccggggccaccacaccaccgagcagagcctgcgcttcgagttcctcaactacccgcccttcacgcgcagcctgcgcggcagccagaggacttgggcccccgagccccgatag

SEQ ID NO: 93 - DNA, 975 bp, Homo sapiens
atgaactgcatgaaaggcccgcttcacttggagcaccgagcagcggggaccaagctgtcggccgtctcctcatcttcctgtcaccatccccagccgttagccatggcttcggttctggctcccggtcagccccggtcgctggactcctccaagcacaggctggaggtgcacaccatctccgacacctccagcccggaggccgcagagaaagataaaagccagcaggggaagaatgaggacgtgggcgccgaggacccgtctaagaagaagcggcaaaggcggcagcggactcactttaccagccagcagctccaggagctggaggccactttccagaggaaccgctacccggacatgtccacacgcgaagaaatcgctgtgtggaccaaccttacggaagcccgagtccgggtttggttcaagaatcgtcgggccaaatggagaaagagggagcgcaaccagcaggccgagctatgcaagaatggcttcgggccgcagttcaatgggctcatgcagccctacgacgacatgtacccaggctattcctacaacaactgggccgccaagggccttacatccgcctccctatccaccaagagcttccccttcttcaactctatgaacgtcaaccccctgtcatcacagagcatgttttccccacccaactctatctcgtccatgagcatgtcgtccagcatggtgccctcagcagtgacaggcgtcccgggctccagtctcaacagcctgaataacttgaacaacctgagtagcccgtcgctgaattccgcggtgccgacgcctgcctgtccttacgcgccgccgactcctccgtatgtttatagggacacgtgtaactcgagcctggccagcctgagactgaaagcaaagcagcactccagcttcggctacgccagcgtgcagaacccggcctccaacctgagtgcttgccagtatgcagtggaccggcccgtgtga

SEQ ID NO: 94 - DNA, 987 bp, Mus musculus
atggccacccaggtgatggggcagtcttctggaggaggcagtctcttcaacaacagtgccaacatgggcatggccttaaccaacgacatgtacgacctgcacgagctctcgaaagctgaactggcagcccctcagctcatcatgttagccaacgtggccctgacgggggaggcaagcggcagctgctgcgattacctggtcggtgaagagaggcagatggccgaattgatgcccgtgggagacaaccacttctcagaaagtgaaggagaaggcctggaagagtcggctgacctcaaagggctggaaaacatggaactgggaagtttggagctaagtgctgtagaaccccagcccgtatttgaagcctcagctgccccagaaatatacagcgccaataaagatcccgctccagaaacacccgtggcggaagacaaatgcaggagttctaaggccaagcccttccggtgtaagccttgccagtacgaagccgaatctgaagagcagtttgtgcatcacatccggattcacagcgctaagaagttctttgtggaggaaagtgcagagaaacaggccaaagcctgggagtcggggtcgtctccggccgaagagggcgagttctccaaaggccccatccgctgtgaccgctgtggctacaataccaaccggtatgaccactacatggcacacctgaagcaccacctgcgagctggcgagaacgagcgcatctacaagtgcatcatctgcacgtacacgacggtcagcgagtaccactggaggaaacacctgagaaaccatttccccaggaaagtctacacctgcagcaagtgcaactacttctcagacagaaaaaataactacgttcagcacgtgcgaactcacacaggagaacgcccgtataaatgtgaactttgtccttactcaagctctcagaagactcatctaacgcgacacatgcggactcattcagagtgtgatctagctgggtga

SEQ ID NO: 95 - DNA, 1025 bp, Homo sapiens
atgaccatggaatctggagccgagaaccagcagagtggagatgcagctgtaacagaagctgaaaaccaacaaatgacagttcaagcccagccacagattgccacattagcccaggtatctatgccagcagctcatgcaacatcatctgctcccaccgtaactctagtacagctgcccaatgggcagacagttcaagtccatggagtcattcaggcggcccagccatcagttattcagtctccacaagtccaaacagttcagtcttcctgtaaggacttaaaaagacttttctccggaacacagatttcaactattgcagaaagtgaagattcacaggagtcagtggatagtgtaactgattcccaaaagcgaagggaaattctttcaaggaggccttcctacaggaaaattttgaatgacttatcttctgatgcaccaggagtgccaaggattgaagaagagaagtctgaagaggagacttcagcacctgccatcaccactgtaacggtgccaactccaatttaccaaactagcagtggacagtatattgccattacccagggaggagcaatacagctggctaacaatggtaccgatggggtacagggcctgcaaacattaaccatgaccaatgcagcagccactcagccgggtactaccattctacagtatgcacagaccactgatggacagcagatcttagtgcccagcaaccaagttgttgttcaagctgcctctggagacgtacaaacataccagattcgcacagcacccactagcactattgcccctggagttgttatggcatcctccccagcacttcctacacagcctgctgaagaagcagcacgaaagagagaggtccgtctaatgaagaacagggaagcagctcgagagtgtcgtagaaagaagaaagaatatgtgaaatgtttagaaaacagagtggcagtgcttgaaaatcaaaacaagacattgattgaggagctaaaagcacttaaggacctttactgccacaaatcagatta

SEQ ID NO: 96 - DNA, 963 bp, Mus musculus
atggctgagggcaaaggggctcctctgaggccttcagttgagaagagatggaagctcatggaacccaagcagacccaggcagggatgttcaagaaaatgagccttgtggactctgacactgctgcaggaaagggtagccaagatgaggcctatactgaactgagcctgccaacagcaccgaacaagcctcgactggacaggcctcgggcctgcaaggcatacacagagcagaggcacaataccttcacagagctatcatgtctccaggagaggccaggggacatccaggcccagacgaggaagctggagaacccagaaggccagctcggccctcagcagctgccctcgagtttcctcagagcctcaggtgatggcacagtgtgttcagcatggccaggtgccccccggagtgagcagaaaagtgctttcagcaagccagccaaacgcccagcagagaaacctaagcgctctcccatgcttctggctggtggaagtgcagagggctcatgggagctctcaggactcatcaccactgtggacatcccatattgggctcatctgtcaactttcaagttcatgggtgatttctggaaattgcacacattgtcacagaacattctcctctgcaatgctttccagggggctcccacaccatggctggagcatacccaggtacaagcccccacatcctcagctccttcctccacagcctcccgggctctcttgccgcccacactctcctccttgggcttgtctactcagaactggtgtgcgaagtgcaacctagcctttcgcctgacagctgacctggtcttccacatgcggtcacatcacaaaagggaacacgtgggccctgacccacattctaagaaacgaagagaggaagttctcacttgccccgtttgccacgagtacttccgggagcgccaccatctgtccaggcatatggcttcacatagttag

SEQ ID NO: 97 - DNA, 1374 bp, Homo sapiens
atgctgggagcggtgaagatggaagggcacgagccgtccgactggagcagctactatgcagagcccgagggctactcctccgtgagcaacatgaacgccggcctggggatgaacggcatgaacacgtacatgagcatgtcggcggccgccatgggcagcggctcgggcaacatgagcgcgggctccatgaacatgtcgtcgtacgtgggcgctggcatgagcccgtccctggcggggatgtcccccggcgcgggcgccatggcgggcatgggcggctcggccggggcggccggcgtggcgggcatggggccgcacttgagtcccagcctgagcccgctcggggggcaggcggccggggccatgggcggcctggccccctacgccaacatgaactccatgagccccatgtacgggcaggcgggcctgagccgcgcccgcgaccccaagacctacaggcgcagctacacgcacgcaaagccgccctactcgtacatctcgctcatcaccatggccatccagcagagccccaacaagatgctgacgctgagcgagatctaccagtggatcatggacctcttccccttctaccggcagaaccagcagcgctggcagaactccatccgccactcgctctccttcaacgactgtttcctgaaggtgccccgctcgcccgacaagcccggcaagggctccttctggaccctgcaccctgactcgggcaacatgttcgagaacggctgctacctgcgccgccagaagcgcttcaagtgcgagaagcagctggcgctgaaggaggccgcaggcgccgccggcagcggcaagaaggcggccgccggagcccaggcctcacaggctcaactcggggaggccgccgggccggcctccgagactccggcgggcaccgagtcgcctcactcgagcgcctccccgtgccaggagcacaagcgagggggcctgggagagctgaaggggacgccggctgcggcgctgagccccccagagccggcgccctctcccgggcagcagcagcaggccgcggcccacctgctgggcccgccccaccacccgggcctgccgcctgaggcccacctgaagccggaacaccactacgccttcaaccacccgttctccatcaacaacctcatgtcctcggagcagcagcaccaccacagccaccaccaccaccaaccccacaaaatggacctcaaggcctacgaacaggtgatgcactaccccggctacggttcccccatgcctggcagcttggccatgggcccggtcacgaacaaaacgggcctggacgcctcgcccctggccgcagatacctcctactaccagggggtgtactcccggcccattatgaactcctcttaa

SEQ ID NO: 98 - DNA, 1221 bp, Homo sapiens
atggatggatggagaaggatgcctcgctggggactgctgctgctgctctggggctcctgtacctttggtctcccgacagacaccaccacctttaaacggatcttcctcaagagaatgccctcaatccgagaaagcctgaaggaacgaggtgtggacatggccaggcttggtcccgagtggagccaacccatgaagaggctgacacttggcaacaccacctcctccgtgatcctcaccaactacatggacacccagtactatggcgagattgggatcgggaccccaccccaaaccttcaaagtcgtctttgacactggttcgtccaatgtttgggtgccctcctccaagtgcagccgtctctacactgcctgtgtgtatcacaagctcttcgatgcttcggattcctccagctacaagcacaatggaacagaactcaccctccgctattcaacagggacagtcagtggctttctcagccaggacatcatcaccgtgggtggaatcacggtgacacagatgtttggagaggtcacggagatgcccgccttacccttcatgctggccgagtttgatggggttgtgggcatgggcttcattgaacaggccattggcagggtcacccctatcttcgacaacatcatctcccaaggggtgctaaaagaggacgtcttctctttctactacaacagagattccgagaattcccaatcgctgggaggacagattgtgctgggaggcagcgacccccagcattacgaagggaatttccactatatcaacctcatcaagactggtgtctggcagattcaaatgaagggggtgtctgtggggtcatccaccttgctctgtgaagacggctgcctggcattggtagacaccggtgcatcctacatctcaggttctaccagctccatagagaagctcatggaggccttgggagccaagaagaggctgtttgattatgtcgtgaagtgtaacgagggccctacactccccgacatctctttccacctgggaggcaaagaatacacgctcaccagcgcggactatgtatttcaggaatcctacagtagtaaaaagctgtgcacactggccatccacgccatggatatcccgccacccactggacccacctgggccctgggggccaccttcatccgaaagttctacacagagtttgatcggcgtaacaaccgcattggcttcgccttggcccgctga

SEQ ID NO: 99 - DNA, 654 bp, Homo sapiens
atgagtctggtaggtggttttccccaccacccggtggtgcaccacgagggctacccgtttgccgccgccgccgccgcagctgccgccgccgccgccagccgctgcagccatgaggagaacccctacttccatggctggctcatcggccaccccgagatgtcgccccccgactacagcatggccctgtcctacagccccgagtatgccagcggcgccgccggcctggaccactcccattacgggggggtgccgccgggcgccgggcccccgggcctgggggggccgcgcccggtgaagcgccgaggcaccgccaaccgcaaggagcggcgcaggactcagagcatcaacagcgccttcgccgaactgcgcgagtgcatccccaacgtacccgccgacaccaaactctccaaaatcaagaccctgcgcctggccaccagctacatcgcctacctcatggacctgctggccaaggacgaccagaatggcgaggcggaggccttcaaggcagagatcaagaagaccgacgtgaaagaggagaagaggaagaaggagctgaacgaaatcttgaaaagcacagtgagcagcaacgacaagaaaaccaaaggccggacgggctggccgcagcacgtctgggccctggagctcaagcagtga

SEQ ID NO: 100 - DNA, 942 bp, Homo sapiens
atgacttcttgtcacattgctgaagaacatatacaaaaggttgctatctttggaggaacccatgggaatgagctaaccggagtatttctggttaagcattggctagagaatggcgctgagattcagagaacagggctggaggtaaaaccatttattactaaccccagagcagtgaagaagtgtaccagatatattgactgtgacctgaatcgcatttttgaccttgaaaatcttggcaaaaaaatgtcagaagatttgccatatgaagtgagaagggctcaagaaataaatcatttatttggtccaaaagacagtgaagattcctatgacattatttttgaccttcacaacaccacctctaacatggggtgcactcttattcttgaggattccaggaataactttttaattcagatgtttcattacattaagacttctctggctccactaccctgctacgtttatctgattgagcatccttccctcaaatatgcgaccactcgttccatagccaagtatcctgtgggtatagaagttggtcctcagcctcaaggggttctgagagctgatatcttggatcaaatgagaaaaatgattaaacatgctcttgattttatacatcatttcaatgaaggaaaagaatttcctccctgcgccattgaggtctataaaattatagagaaagttgattacccccgggatgaaaatggagaaattgctgctatcatccatcctaatctgcaggatcaagactggaaaccactgcatcctggggatcccatgtttttaactcttgatgggaagacgatcccactgggcggagactgtaccgtgtaccccgtgtttgtgaatgaggccgcatattacgaaaagaaagaagcttttgcaaagacaactaaactaacgctcaatgcaaaaagtattcgctgctgtttacattag

SEQ ID NO: 101 - DNA, 1590 bp, Homo sapiens
atgacaagctccaggctttggttttcgctgctgctggcggcagcgttcgcaggacgggcgacggccctctggccctggcctcagaacttccaaacctccgaccagcgctacgtcctttacccgaacaactttcaattccagtacgatgtcagctcggccgcgcagcccggctgctcagtcctcgacgaggccttccagcgctatcgtgacctgcttttcggttccgggtcttggccccgtccttacctcacagggaaacggcatacactggagaagaatgtgttggttgtctctgtagtcacacctggatgtaaccagcttcctactttggagtcagtggagaattataccctgaccataaatgatgaccagtgtttactcctctctgagactgtctggggagctctccgaggtctggagacttttagccagcttgtttggaaatctgctgagggcacattctttatcaacaagactgagattgaggactttccccgctttcctcaccggggcttgctgttggatacatctcgccattacctgccactctctagcatcctggacactctggatgtcatggcgtacaataaattgaacgtgttccactggcatctggtagatgatccttccttcccatatgagagcttcacttttccagagctcatgagaaaggggtcctacaaccctgtcacccacatctacacagcacaggatgtgaaggaggtcattgaatacgcacggctccggggtatccgtgtgcttgcagagtttgacactcctggccacactttgtcctggggaccaggtatccctggattactgactccttgctactctgggtctgagccctctggcacctttggaccagtgaatcccagtctcaataatacctatgagttcatgagcacattcttcttagaagtcagctctgtcttcccagatttttatcttcatcttggaggagatgaggttgatttcacctgctggaagtccaacccagagatccaggactttatgaggaagaaaggcttcggtgaggacttcaagcagctggagtccttctacatccagacgctgctggacatcgtctcttcttatggcaagggctatgtggtgtggcaggaggtgtttgataataaagtaaagattcagccagacacaatcatacaggtgtggcgagaggatattccagtgaactatatgaaggagctggaactggtcaccaaggccggcttccgggcccttctctctgccccctggtacctgaaccgtatatcctatggccctgactggaaggatttctacgtagtggaacccctggcatttgaaggtacccctgagcagaaggctctggtgattggtggagaggcttgtatgtggggagaatatgtggacaacacaaacctggtccccaggctctggcccagagcaggggctgttgccgaaaggctgtggagcaacaagttgacatctgacctgacatttgcctatgaacgtttgtcacacttccgctgtgagttgctgaggcgaggtgtccaggcccaacccctcaatgtaggcttctgtgagcaggagtttgaacagacctga

SEQ ID NO: 102 - DNA, 657 bp, Homo sapiens
atggcgacccgcagccctggcgtcgtgattagtgatgatgaaccaggttatgaccttgatttattttgcatacctaatcattatgctgaggatttggaaagggtgtttattcctcatggactaattatggacaggactgaacgtcttgctcgagatgtgatgaaggagatgggaggccatcacattgtagccctctgtgtgctcaaggggggctataaattctttgctgacctgctggattacatcaaagcactgaatagaaatagtgatagatccattcctatgactgtagattttatcagactgaagagctattgtaatgaccagtcaacaggggacataaaagtaattggtggagatgatctctcaactttaactggaaagaatgtcttgattgtggaagatataattgacactggcaaaacaatgcagactttgctttccttggtcaggcagtataatccaaagatggtcaaggtcgcaagcttgctggtgaaaaggaccccacgaagtgttggatataagccagactttgttggatttgaaattccagacaagtttgttgtaggatatgcccttgactataatgaatacttcagggatttgaatcatgtttgtgtcattagtgaaactggaaaagcaaaatacaaagcctaa

SEQ ID NO: 103 - DNA, 1956 bp, Homo sapiens
atggcccgggggtcggcggttgcctgggcggcgctcgggccgttgttgtggggctgcgcgctggggctgcagggcgggatgctgtacccccaggagagcccgtcgcgggagtgcaaggagctggacggcctctggagcttccgcgccgacttctctgacaaccgacgccggggcttcgaggagcagtggtaccggcggccgctgtgggagtcaggccccaccgtggacatgccagttccctccagcttcaatgacatcagccaggactggcgtctgcggcattttgtcggctgggtgtggtacgaacgggaggtgatcctgccggagcgatggacccaggacctgcgcacaagagtggtgctgaggattggcagtgcccattcctatgccatcgtgtgggtgaatggggtcgacacgctagagcatgaggggggctacctccccttcgaggccgacatcagcaacctggtccaggtggggcccctgccctcccggctccgaatcactatcgccatcaacaacacactcacccccaccaccctgccaccagggaccatccaatacctgactgacacctccaagtatcccaagggttactttgtccagaacacatattttgactttttcaactacgctggactgcagcggtctgtacttctgtacacgacacccaccacctacatcgatgacatcaccgtcaccaccagcgtggagcaagacagtgggctggtgaattaccagatctctgtcaagggcagtaacctgttcaagttggaagtgcgtcttttggatgcagaaaacaaagtcgtggcgaatgggactgggacccagggccaacttaaggtgccaggtgtcagcctctggtggccgtacctgatgcacgaacgccctgcctatctgtattcattggaggtgcagctgactgcacagacgtcactggggcctgtgtctgacttctacacactccctgtggggatccgcactgtggctgtcaccaagagccagttcctcatcaatgggaaacctttctatttccacggtgtcaacaagcatgaggatgcggacatccgagggaagggcttcgactggccgctgctggtgaaggacttcaacctgcttcgctggcttggtgccaacgctttccgtaccagccactacccctatgcagaggaagtgatgcagatgtgtgaccgctatgggattgtggtcatcgatgagtgtcccggcgtgggcctggcgctgccgcagttcttcaacaacgtttctctgcatcaccacatgcaggtgatggaagaagtggtgcgtagggacaagaaccaccccgcggtcgtgatgtggtctgtggccaacgagcctgcgtcccacctagaatctgctggctactacttgaagatggtgatcgctcacaccaaatccttggacccctcccggcctgtgacctttgtgagcaactctaactatgcagcagacaagggggctccgtatgtggatgtgatctgtttgaacagctactactcttggtatcacgactacgggcacctggagttgattcagctgcagctggccacccagtttgagaactggtataagaagtatcagaagcccattattcagagcgagtatggagcagaaacgattgcagggtttcaccaggatccacctctgatgttcactgaagagtaccagaaaagtctgctagagcagtaccatctgggtctggatcaaaaacgcagaaaatacgtggttggagagctcatttggaattttgccgatttcatgactgaacagtcaccgacgagagtgctggggaataaaaaggggatcttcactcggcagagacaaccaaaaagtgcagcgttccttttgcgagagagatactggaagattgccaatgaaaccaggtatccccactcagtagccaagtcacaatgtttggaaaacagcccgtttacttga

SEQ ID NO: 104 - DNA, 1671 bp, Homo sapiens
atggagctgtgcgggctggggctgccccggccgcccatgctgctggcgctgctgttggcgacactgctggcggcgatgttggcgctgctgactcaggtggcgctggtggtgcaggtggcggaggcggctcgggccccgagcgtctcggccaagccggggccggcgctgtggcccctgccgctctcggtgaagatgaccccgaacctgctgcatctcgccccggagaacttctacatcagccacagccccaattccacggcgggcccctcctgcaccctgctggaggaagcgtttcgacgatatcatggctatatttttggtttctacaagtggcatcatgaacctgctgaattccaggctaaaacccaggttcagcaacttcttgtctcaatcacccttcagtcagagtgtgatgctttccccaacatatcttcagatgagtcttatactttacttgtgaaagaaccagtggctgtccttaaggccaacagagtttggggagcattacgaggtttagagacctttagccagttagtttatcaagattcttatggaactttcaccatcaatgaatccaccattattgattctccaaggttttctcacagaggaattttgattgatacatccagacattatctgccagttaagattattcttaaaactctggatgccatggcttttaataagtttaatgttcttcactggcacatagttgatgaccagtctttcccatatcagagcatcacttttcctgagttaagcaataaaggaagctattctttgtctcatgtttatacaccaaatgatgtccgtatggtgattgaatatgccagattacgaggaattcgagtcctgccagaatttgatacccctgggcatacactatcttggggaaaaggtcagaaagacctcctgactccatgttacagtagacaaaacaagttggactcttttggacctataaaccctactctgaatacaacatacagcttccttactacatttttcaaagaaattagtgaggtgtttccagatcaattcattcatttgggaggagatgaagtggaatttaaatgttgggaatcaaatccaaaaattcaagatttcatgaggcaaaaaggctttggcacagattttaagaaactagaatctttctacattcaaaaggttttggatattattgcaaccataaacaagggatccattgtctggcaggaggtttttgatgataaagcaaagcttgcgccgggcacaatagttgaagtatggaaagacagcgcatatcctgaggaactcagtagagtcacagcatctggcttccctgtaatcctttctgctccttggtacttagatttgattagctatggacaagattggaggaaatactataaagtggaacctcttgattttggcggtactcagaaacagaaacaacttttcattggtggagaagcttgtctatggggagaatatgtggatgcaactaacctcactccaagattatggcctcgggcaagtgctgttggtgagagactctggagttccaaagatgtcagagatatggatgacgcctatgacagactgacaaggcaccgctgcaggatggtcgaacgtggaatagctgcacaacctctttatgctggatattgtaaccatgagaacatgtaa

SEQ ID NO: 105 - DNA, 1290 bp, Homo sapiens
atgcagctgaggaacccagaactacatctgggctgcgcgcttgcgcttcgcttcctggccctcgtttcctgggacatccctggggctagagcactggacaatggattggcaaggacgcctaccatgggctggctgcactgggagcgcttcatgtgcaaccttgactgccaggaagagccagattcctgcatcagtgagaagctcttcatggagatggcagagctcatggtctcagaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatcttttaaccaggagagaattgttgatgttgctggaccagggggttggaatgacccagatatgttagtgattggcaactttggcctcagctggaatcagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactttaa

SEQ ID NO: 106 - DNA, 1611 bp, Homo sapiens
atggagttttcaagtccttccagagaggaatgtcccaagcctttgagtagggtaagcatcatggctggcagcctcacaggattgcttctacttcaggcagtgtcgtgggcatcaggtgcccgcccctgcatccctaaaagcttcggctacagctcggtggtgtgtgtctgcaatgccacatactgtgactcctttgaccccccgacctttcctgcccttggtaccttcagccgctatgagagtacacgcagtgggcgacggatggagctgagtatggggcccatccaggctaatcacacgggcacaggcctgctactgaccctgcagccagaacagaagttccagaaagtgaagggatttggaggggccatgacagatgctgctgctctcaacatccttgccctgtcaccccctgcccaaaatttgctacttaaatcgtacttctctgaagaaggaatcggatataacatcatccgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccacttggctcaagaccaatggagcggtgaatgggaaggggtcactcaagggacagcccggagacatctaccaccagacctgggccagatactttgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccctcgccaacagtactcaccacaatgtccgcctactcatgctggatgaccaacgcttgctgctgccccactgggcaaaggtggtactgacagacccagaagcagctaaatatgttcatggcattgctgtacattggtacctggactttctggctccagccaaagccaccctaggggagacacaccgcctgttccccaacaccatgctctttgcctcagaggcctgtgtgggctccaagttctgggagcagagtgtgcggctaggctcctgggatcgagggatgcagtacagccacagcatcatcacgaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcagcaagttcattcctgagggctcccagagagtggggctggttgccagtcagaagaacgacctggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggcgtcgccagtga

SEQ ID NO: 107 - DNA, 642 bp, Homo sapiens
atgccccggagggcggagaactgggacgaggccgaggtaggcgcggaggaggcaggcgtcgaagagtacggccctgaagaagacggcggggaggagtcgggcgccgaggagtccggcccggaagagtccggcccggaggaactgggcgccgaggaggagatggaggccgggcggccgcggcccgtgctgcgctcggtgaactcgcgcgagccctcccaggtcatcttctgcaatcgcagtccgcgcgtcgtgctgcccgtatggctcaacttcgacggcgagccgcagccctacccaacgctgccgcctggcacgggccgccgcatccacagctaccgaggtcacctttggctcttcagagatgcagggacacacgatgggcttctggttaaccaaactgaattatttgtgccatctctcaatgttgacggacagcctatttttgccaatatcacactgccagtgtatactctgaaagagcgatgcctccaggttgtccggagcctagtcaagcctgagaattacaggagactggacatcgtcaggtcgctctacgaagatctggaagaccacccaaatgtgcagaaagacctggagcggctgacacaggagcgcattgcacatcaacggatgggagattga

SEQ ID NO: 108 - DNA, 444 bp, Homo sapiens
atggtgcatctgactcctgaggagaagtctgccgttactgccctgtggggcaaggtgaacgtggatgaagttggtggtgaggccctgggcaggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgtgacaagctgcacgtggatcctgagaacttcaggctcctgggcaacgtgctggtctgtgtgctggcccatcactttggcaaagaattcaccccaccagtgcaggctgcctatcagaaagtggtggctggtgtggctaatgccctggcccacaagtatcactaa

SEQ ID NO: 109 - DNA, 951 bp, Homo sapiens
atgatagtgtttgtcaggttcaactccagccatggtttcccagtggaggtcgattctgacaccagcatcttccagctcaaggaggtggttgctaagcgacagggggttccggctgaccagttgcgtgtgattttcgcagggaaggagctgaggaatgactggactgtgcaggaatttttctttaaatgtggagcacaccccacctctgacaaggaaacatcagtagctttgcacctgatcgcaacaaatagtcggaacatcacttgcattacgtgcacagacgtcaggagccccgtcctggttttccagtgcaactcccgccacgtgatttgcttagactgtttccacttatactgtgtgacaagactcaatgatcggcagtttgttcacgaccctcaacttggctactccctgccttgtgtggctggctgtcccaactccttgattaaagagctccatcacttcaggattctgggagaagagcagtacaaccggtaccagcagtatggtgcagaggagtgtgtcctgcagatggggggcgtgttatgcccccgccctggctgtggagcggggctgctgccggagcctgaccagaggaaagtcacctgcgaagggggcaatggcctgggctgtgggtttgccttctgccgggaatgtaaagaagcgtaccatgaaggggagtgcagtgccgtatttgaagcctcaggaacaactactcaggcctacagagtcgatgaaagagccgccgagcaggctcgttgggaagcagcctccaaagaaaccatcaagaaaaccaccaagccctgtccccgctgccatgtaccagtggaaaaaaatggaggctgcatgcacatgaagtgtccgcagccccagtgcaggctcgagtggtgctggaactgtggctgcgagtggaaccgcgtctgcatgggggaccactggttcgacgtgtag

SEQ ID NO: 110 - DNA, 1046 bp, Homo sapiens
aaggacaacggccatccctgtggctgggccgccggctacgcaatgctgtctctcttgctgatcctctcaggcctgggccggctgacctccgcgggcccacgccacttattccatcaaaattgaggggaaaccatacacttcctgcttgaaaaacagtcatttttacacccacatttcctggtgtatttatacaacaaatcaggaacattgtatgcagattcttcattttcaaagggtcattgcttttaccaaggatatgctgcagacattccaaaatcagttgtggcactacgcacctgttctggactcagatgttttcccagcttaatatgacagttatgctgccttccttggagatctggtcagatcaaaataagatttcaacaagtggtcatgctgatgaaatactacagcgatttttgccttggaaacaaaaatttttgtttcaaaggtctcatgatatgacatacttattaatttataggaaccattctacttatgtgggagcaacatatcacggaatggcatgcgatccaaagtttgcaacaggaattgctctgtatccaaagaaaatcactgcagaggccttttcagttgttatggcacagttgcttggaattaatctgggattgacatatgatgatatctacaattgttactgtccaggaactacatgcataatgaatcctgatgcgatatgatcccatggtatgaagttttttagcagttgcagcatggatggatttaaacggatagttctgcagcctgaacttaaatgttttcaggataaaacagtttcaaaaatgacttaccgaaaatcttcaacttgtggcaatggaattttggaacctacagagcagtgtgattgtggctataaagaggcatgcactcataaaaaatgctgtaatcctgcagattgtactctagttagatctgcagaatgtggcactggatcatgctgtaacaataaaacttgtacgatccacgaaagaggccatgtctgcagaaaaagtgtagatatgtgtgattttccagaatattgcaat

SEQ ID NO: 111 - DNA, 3334 bp, Homo sapiens
gcctgtctgcgcaagcgctaaccaagaaacgacggtttcgggtagattgttggttaagaagaaagctgggaaagtgaaggagagggggaagaaaggaagtgaaaagactttggctgttggaatctcagatctggaataggctgtataggctatttataatctctaattgccgaggaacctgaagttcagagttaaccagtgactgactcaggacatgcaaaatggcaagacccgaggtagaagagctcacctttcctgactctcagtttcctgttccctgaaaatgtaagctaagctggcagccctgtcccagcaagggggaggtacatggaaggccacaggaagaaacaagatcttgagctgagcaagaacatcccagcatcttcattgactttaaaagtatattctggagtcttccgtggttcactattccagtactacagagattccttatattacatggcaggaggggggtaaactgagggatagtgaagacaacaataaattaatcaagagctttcctcatatctcagaacctatcctctgtaagaatgtcagaaaaggttgactggttacaaagccaaaatggagtatgcaaagttgatgtctattctcctggagacaaccaagcccaggactggaaaatggacacctccacggatcctgtcagagtgctcagctggctccgcagagacctggagaagagtacagcagagttccaagatgttcggttcaaacccggagaatcatttggtggggaaacgtccaactcaggagacccacacaaaggtttctctgtagactattacaacaccaccaccaagggcactccagaaagattgcattttgagatgactcacaaagagattccttgccagggccccagggcccaacttggcaacgggagttcagtagatgaagtttccttctatgctaaccgcctcacgaatctagtcatagccatggcccgcaaagagatcaatgagaagatcgatggctctgaaaacaaatgtgtctatcagtcattgtacatggggaatgaacccacacccaccaaaagcctcagtaagatagcatcagagcttgtgaatgagaccgtctctgcatgttccaggaatgctgccccagacaaggctcctggctctggagacagagtctcgggatcatcacaaagtcccccaaatttgaaatacaagtccactttgaagatcaaggagagcaccaaagaaagacagggtccagatgacaagcctccttctaagaagtctttcttctataaggaagtgtttgaatctcgtaatggagattatgccagagagggtggaaggttctttcctcgggagagaaagaggtttcgagggcaggaaaggcctgatgactttacggcttctgttagtgaagggatcatgacctatgctaacagtgtggtatctgatatgatggtctccatcatgaagacactgaagatccaagtgaaagacacaaccattgccaccatcctactgaagaaggttctgctcaagcatgcaaaagaggtggtctcggatctcatcgactccttcttgaggaatctccacagcgtcacagggaccctcatgactgacacacagtttgtctcggctgtgaaaagaactgtcttctctcatggaagccaaaaggccacagatatcatggatgccatgctaaggaagctgtacaatgtaatgtttgccaagaaagtccctgagcatgtcaggaaagcccaagacaaggctgagagttattccctcatctccatgaaaggaatgggtgatcctaaaaaccgaaatgtgaactttgccatgaaatctgaaactaaattgagagaaaaaatgtattctgaacccaaatcagaggaggagacttgtgcgaaaactctgggtgagcacattatcaaagaggggcttaccttgtggcataaaactcagcagaaagaatgtaaatctctaggtttccagcatgcagcatttgaagctcccaacacacagcgtaagcctgcatcagacatttcctttgagtaccctgaagatattggcaacctcagccttcctccatatcctccagagaaacctgagaattttatgtatgattcagactcctgggccgaggacctgatcgtgtctgccctgcttctgattcaatatcacctggcccagggaggaagaagggatgcacggagcttcgttgaagctgctggcaccaccaactttcctgccaatgaacctcctgtagctcccgatgaatcttgccttaagtctgctcccattgtaggtgaccaagaacaagcagaaaagaaggacctaaggagtgttttctttaatttcatccggaacttacttagtgagaccattttcaagcgtgaccagagccctgaacccaaggtgccggaacagccagttaaggaagataggaagttgtgtgaaagaccgttggcgtcttctccccccaggctatatgaggatgatgagacccctggtgccctttctgggctgaccaagatggctgtcagccagatagatggccacatgagtgggcagatggtagaacatctgatgaactcagtgatgaagctgtgtgtcatcattgctaagtcctgtgatgcttcgttggcagagctgggagatgacaagtctggagatgccagtaggctaacttcggccttcccagatagtttatatgagtgcttaccagccaagggcacagggtcagcagaagctgtcctgcagaatgcctatcaagctatccataatgaaatgagaggcacatcaggacagccccctgaagggtgtgcagcacccacggtgattgtcagcaatcacaacctaacggacacagttcagaacaagcaactccaagccgtccttcaatgggtagctgcctctgagctcaatgtccctattttgtattttgctggtgatgatgaagggatccaggagaagctacttcagctctcagctgctgctgtggacaaaggatgcagtgtgggcgaggttctgcagtcggtgctgcgctatgagaaggagcgccagctgaatgaggcggtggggaatgtcacaccgctgcagctgctggactggctgatggtgaacctgtaatcggcaaccccactgctttcccctcttctggcagtggggccggcccttatccccgcccttctttctcacttccacatctccccctctatatcctcacagagccctaacattatcttcacaccactctcatcaaagacatgtcatcttgtgctagccactggattttgcagattttcctgtccatgcaagcaaggacgtaaaattaaaaaattacaattaaa

SEQ ID NO: 112 - DNA, 3323 bp, Homo sapiens
gtctgcgcaagcgctaaccaagaaacgacggtttcgggtagattgttggttaagaagaaagctgggaaagtgaaggagagggggaagaaaggaagtgaaaagactttggctgttggaatctcagatctggaataggctgtataggctatttataatctctaattgccgaggaacctgaagttcagagttaaccagtgactgactcaggacatgcaaaatggcaagacccgaggtagaagagctcacctttcctgactctcagtttcctgttccctgaaaattcccagcaagggggaggtacatggaaggccacaggaagaaacaagatcttgagctgagcaagaacatcccagcatcttcattgactttaaaagtatattctggagtcttccgtggttcactattccagtactacagagattccttatattacatggcaggaggggggtaaactgagggatagtgaagacaacaataaattaatcaagagctttcctcatatctcagaacctatcctctgtaagaatgtcagaaaaggttgactggttacaaagccaaaatggagtatgcaaagttgatgtctattctcctggagacaaccaagcccaggactggaaaatggacacctccacggatcctgtcagagtgctcagctggctccgcagagacctggagaagagtacagcagagttccaagatgttcggttcaaacccggagaatcatttggtggggaaacgtccaactcaggagacccacacaaaggtttctctgtagactattacaacaccaccaccaagggcactccagaaagattgcattttgagatgactcacaaagagattccttgccagggccccagggcccaacttggcaacgggagttcagtagatgaagtttccttctatgctaaccgcctcacgaatctagtcatagccatggcccgcaaagagatcaatgagaagatcgatggctctgaaaacaaatgtgtctatcagtcattgtacatggggaatgaacccacacccaccaaaagcctcagtaagatagcatcagagcttgtgaatgagaccgtctctgcatgttccaggaatgctgccccagacaaggctcctggctctggagacagagtctcgggatcatcacaaagtcccccaaatttgaaatacaagtccactttgaagatcaaggagagcaccaaagaaagacagggtccagatgacaagcctccttctaagaagtctttcttctataaggaagtgtttgaatctcgtaacggagattatgccagagagggtggaaggttctttcctcgggagagaaagaggtttcgagggcaggaaaggcctgatgactttacggcttctgttagtgaagggatcatgacctatgctaacagtgtggtatctgatatgatggtctccatcatgaagacactgaagatccaagtgaaagacacaaccattgccaccatcctactgaagaaggttctgctcaagcatgcaaaagaggtggtctcggatctcatcgactccttcttgaggaatctccacagcgtcacagggaccctcatgactgacacacagtttgtctcggctgtgaaaagaactgtcttctctcatggaagccaaaaggccacagatatcatggatgccatgctaaggaagctgtacaatgtaatgtttgccaagaaagtccctgagcatgtcaggaaagcccaagacaaggctgagagttattccctcatctccatgaaaggaatgggtgatcctaaaaaccgaaatgtgaactttgccatgaaatctgaaactaaattgagagaaaaaatgtattctgaacccaaatcagaggaggagacttgtgcgaaaactctgggtgagcacattatcaaagaggggcttaccctgtggcataaaagtcagcagaaagaatgtaaatctctaggtttccagcatgcagcattcgaagctcccaacacacagcgtaagcctgcatcagacatttcctttgagtaccctgaagatattggcaacctcagccttcctccatatcctccagagaaacctgagaattttatgtatgattcagactcctgggccaaggacctgatcgtgtctgccctgcttctgattcaatatcacctggcccagggaggaagaagggatgcacggagcttcgttgaagctgctggcaccaccaactttcctgccaatgaacctcctgtagctcccgatgaatcttgccttaagtctgctcccattgtaggtgaccaagaacaagcagaaaagaaggacctaaggagtgttttctttaatttcatccggaacttacttagtgagaccattttcaagcgtgaccagagccctgaacccaaggtgccggaacagccagttaaggaagataggaagttgtgtgaaagaccgttggcgtcttctccccccaggctatatgaggatgatgagacccctggtgccctttctgggctgaccaagatggctgtcagccagatagatggccacatgagtgggcagatggtagaacatctgatgaactcagtgatgaagctgtgtgtcatcattgctaagtcctgtgatgcttcgttggcagagctgggagatgacaagtctggagatgccagtaggctaacttcggccttcccagatagtttatatgagtgcttaccagccaagggcacagggtcagcagaagctgtcctgcagaatgcctatcaagctatccataatgaaatgagaggcacatcaggacagccccctgaagggtgtgcagcacccacggtgattgtcagcaatcacaacctaacggacacagttcagaacaagcaactccaagccgtccttcaatgggtagctgcctctgagctcaatgtccctattttgtattttgctggtgatgatgaagggatccaggagaagctacttcagctctcagctgctgctgtggacaaaggatgcagtgtgggcgaggttctgcagtcggtgctgcgctatgagaaggagcgccagctgaatgaggcggtggggaatgtcacaccgctgcagctgctggactggctgatggtgaacctgtaatcggcaaccccactgctttcccctcttctggcagtggggccggcccttatccccgcccttctttctcacttccacatctccccctctatatcctcacagagccctaacattatcttcacaccactctcatcaaagacatgtcatcttgtgctagccactggattttgcagattttcctgtccatgcaagcaaggacgtaaaattaaaaaattacaattaaagggctccacaaaaaa

SEQ ID NO: 113 - DNA, 1997 bp, Homo sapiens
actttcttttgtaaatgtggtttctacaaagatgaaactactaaaacttacaggttttatttttttcttgttttttttgactgaatccctaaccctgcccacacaacctcgggatatagagaacttcaatagtactcaaaaatttatagaagataatattgaatacatcaccatcattgcatttgctcagtatgttcaggaagcaacctttgaagaaatggaaaagctggtgaaagacatggtagaatacaaagacagatgtatggctgacaagacgctcccagagtgttcaaaattacctaataatgttttacaggaaaaaatatgtgctatggaggggctgccacaaaagcataatttctcacactgctgcagtaaggttgatgctcaaagaagactctgtttcttctataacaagaaatctgatgtgggatttctgcctcctttccctaccctggatcccgaagagaaatgccaggcttatgaaagtaacagagaatcccttttaaatcactttttatatgaagttgccagaaggaacccatttgtcttcgcccctacacttctaactgttgctgttcattttgaggaggtggccaaatcatgttgtgaagaacaaaacaaagtcaactgccttcaaacaagggcaatacctgtcacacaatatttaaaagcattttcttcttatcaaaaacatgtctgtggggcacttttgaaatttggaaccaaagttgtacactttatatatattgcgatactcagtcaaaaattccccaagattgaatttaaggagcttatttctcttgtagaagatgtttcttccaactatgatggatgctgtgaaggggatgttgtgcagtgcatccgtgacacgagcaaggttatgaaccatatttgttcaaaacaagattctatctccagcaaaatcaaagagtgctgtgaaaagaaaataccagagcgcggccagtgcataattaactcaaacaaagatgatagaccaaaggatttatctctaagagaaggaaaatttactgacagtgaaaatgtgtgtcaagaacgagatgctgacccagacaccttctttgcgaagtttacttttgaatactcaaggagacatccagacctgtctataccagagcttttaagaattgttcaaatatacaaagatctcctgagaaattgctgcaacacagaaaaccctccaggttgttaccgttacgcggaagacaaattcaatgagacaactgagaaaagcctcaagatggtacaacaagaatgtaaacatttccagaatttggggaaggatggtttgaaataccattacctcatcaggctcacgaagatagctccccaactctccactgaagaactggtgtctcttggcgagaaaatggtgacagctttcactacttgctgtacgctaagtgaagagtttgcctgtgttgataatttggcagatttagtttttggagagttatgtggagtaaatgaaaatcgaactatcaaccctgctgtggaccactgctgtaaaacaaactttgccttcagaaggccctgctttgagagtttgaaagctgataaaacatatgtgcctccacctttctctcaagatttatttacctttcacgcagacatgtgtcaatctcagaatgaggagcttcagaggaagacagacaggtttcttgtcaacttagtgaagctgaagcatgaactcacagatgaagagctgcagtctttgtttacaaatttcgcaaatgtagtggataagtgctgcaaagcagagagtcctgaagtctgctttaatgaagagagtccaaaaattggcaactgaagccagctgctggagatatgtaaagaaaaaagcaccaaagggaaggcttcctatctgtgtggtgatgaatcgcatttcctgagaacaaaataaaaggatttttctgtaactgtcacctgaaataatacattgcagcaagcaataaacacaacattttgtaaagtta

SEQ ID NO: 114 - DNA, 1261 bp, Homo sapiens
ccacggctgctcacgacgccgcggatcccgaagcctgtgtagcagtgagacatcagtgaggctgcaggacgagcaggattggaagcgccccggccagaaagtgaccccccacccctttcaggaccctgtgaacgggaacagccatccagagggttcaggaaggcgtccgcgccctcacctcttctccccatgagctcccccagagctgtggtgcagctgggcaaagctcaacctgcaggcgaagagttggctacagcaaaccaaacagcccagcagcccagcagcccagccatgcggcgcctcacagtcgatgactttgaaatcgggcgtcccctgggcaaggggaaatttgggaatgtgtacctggctcggctcaaggaaagccatttcattgtggccctgaaggttctcttcaagtcgcagatagagaaggaaggactggagcaccagctgcgccgggaaattgagatccaggctcatctacaacaccccaatatcctgcgcctgtataactatttccatgatgcacgccgggtgtacctgattctggaatatgctccaaggggtgagctctacaaggagctgcagaaaagcgagaaattagatgaacagcgcacagccacgataatagaggagttggcagatgccctgacctactgccatgacaagaaagtgattcacagagatattaagccagagaacctgctgctggggttcaggggtgaggtgaagattgcagattttggctggtctgtgcacaccccctccctgaggaggaagacaatgtgtgggacactggactacttgccgccagaaatgattgaggggagaacatatgatgaaaaggtggatttgtggtgcattggagtgctctgctatgagctgctggtgggatatccaccctttgagagcgcctcccacagtgagacttacagacgcatcctcaaggtagatgtgaggtttccactatcaatgcctctgggggcccgggacttgatttccaggcttctcagataccagcccttggagagactgcccctggcccagatcctgaagcacccctgggttcaggcccactcccgaagggtgctgcctccctgtgctcagatggcttcctgagccctgtctgcctctgttccctttgtgtgtgttcagggagctctcctggctctgccacctcatttgtctttatttttttctcttttaagatgtaagatgctaattaataaaagctgaatcatttcataccaaaaaaaaaaaa

SEQ ID NO: 115 - DNA, 1120 bp, Homo sapiens
ggaagtacctctctgagcggttggtgccgggtataaaagaaggccgcgcagccacggctgctcacgacgccgcggatcccgaagcctgtgtagcagtgagacatcatggctacagcaaaccaaacagcccagcagcccagcagcccagccatgcggcgcctcacagtcgatgactttgaaatcgggcgtcccctgggcaaggggaaatttgggaatgtgtacctggctcggctcaaggaaagccatttcattgtggccctgaaggttctcttcaagtcgcagatagagaaggaaggactggagcaccagctgcgccgggaaattgagatccaggctcatctacaacaccccaatatcctgcgcctgtataactatttccatgatgcacgccgggtgtacctgattctggaatatgctccaaggggtgagctctacaaggagctgcagaaaagcgagaaattagatgaacagcgcacagccacgataatagaggagttggcagatgccctgacctactgccatgacaagaaagtgattcacagagatattaagccagagaacctgctgctggggttcaggggtgaggtgaagattgcagattttggctggtctgtgcacaccccctccctgaggaggaagacaatgtgtgggacactggactacttgccgccagaaatgattgaggggagaacatatgatgaaaaggtggatttgtggtgcattggagtgctctgctatgagctgctggtgggatatccaccctttgagagcgcctcccacagtgagacttacagacgcatcctcaaggtagatgtgaggtttccactatcaatgcctctgggggcccgggacttgatttccaggcttctcagataccagcccttggagagactgcccctggcccagatcctgaagcacccctgggttcaggcccactcccgaagggtgctgcctccctgtgctcagatggcttcctgagccctgtctgcctctgttccctttgtgtgtgttcagggagctctcctggctctgccacctcatttgtctttatttttttctcttttaagatgtaagatgctaattaataaaagctgaatcatttcataccaaaaaaaaaaaa

SEQ ID NO: 116 - DNA, 1262 bp, Homo sapiens
tcccttgggcttgtgttggggcctgttgttgaacactaagcctttcaagatggtcctcctcagtattcttagaattctttttctttgtgaactcgtgcttttcatggaacacagggcccaaatggcagaaggagggcagtcctctattgcccttctggctgaggcccctactttgcccctgattgaggagctgctagaagaatcccctggcgaacagccaaggaagccccggctcctagggcattcactgcggtacatgctggagttgtaccggcgttcagctgactcgcatgggcaccctagagagaaccgcaccattggggccaccatggtgaggctggtgaagcccttgaccaatgtggcaaggcctcacagaggtacctggcatatacagatcctgggctttcctctcagaccaaaccgaggactataccaactagttagagccactgtggtttaccgccatcatctccaactaactcgcttcaatctctcctgccatgtggagccctgggtgcagaaaaacccaaccaaccacttcccttcctcagaaggagattcctcaaaaccttccctgatgtctaacgcttggaaagagatggatatcacacaacttgttcagcaaaggttctggaataacaagggacacaggatcctacgactccgttttatgtgtcagcagcaaaaagatagtggtggtcttgagctctggcatggcacttcatccttggacattgccttcttgttactctatttcaatgatactcataaaagcattcggaaggctaaatttcttcccaggggcatggaggagttcatggaaagggaatctcttctccggagaacccgacaagcagatggtatctcagctgaggttactgcctcttcctcaaaacatagcgggcctgaaaataaccagtgttccctccaccctttccaaatcagcttccgccagctgggttgggatcactggatcattgctccccctttctacaccccaaactactgtaaaggaacttgtctccgagtactacgcgatggtctcaattcccccaatcacgccattattcagaaccttatcaatcagttggtggaccagagtgtcccccggccctcctgtgtcccgtataagtatgttccaattagtgtccttatgattgaggcaaatgggagtattttgtacaaggagtatgagggtatgattgctgagtcttgtacatgcagatgacagcaacagtacggctagatcaggtttcccagga

SEQ ID NO: 117 - DNA, 2010 bp, Homo sapiens
cgaacgccttcgcgcgatcgccctggaaacgcattctctgcgaccggcagccgccaatgggaagggagtgagtgccacgaacaggccaataaggagggagcagtgcggggtttaaatctgaggctaggctggctcttctcggcgtgctgcggcggaacggctgttggtttctgctgggtgtaggtccttggctggtcgggcctccggtgttctgcttctccccgctgagctgctgcctggtgaagaggaagccatggcgctccgagtcaccaggaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgagaataattgtgtgcccaagaagatgctgcagctggttggtgtcactgccatgtttattgcaagcaaatatgaagaaatgtaccctccagaaattggtgactttgcttttgtgactgacaacacttatactaagcaccaaatcagacagatggaaatgaagattctaagagctttaaactttggtctgggtcggcctctacctttgcacttccttcggagagcatctaagattggagaggttgatgtcgagcaacatactttggccaaatacctgatggaactaactatgttggactatgacatggtgcactttcctccttctcaaattgcagcaggagctttttgcttagcactgaaaattctggataatggtgaatggacaccaactctacaacattacctgtcatatactgaagaatctcttcttccagttatgcagcacctggctaagaatgtagtcatggtaaatcaaggacttacaaagcacatgactgtcaagaacaagtatgccacatcgaagcatgctaagatcagcactctaccacagctgaattctgcactagttcaagatttagccaaggctgtggcaaaggtgtaacttgtaaacttgagttggagtactatatttacaaataaaattggcaccatgtgccatctgtacatattactgttgcatttacttttaataaagcttgtggccccttttacttttttatagcttaactaatttgaatgtggttacttcctactgtagggtagcggaaaagttgtcttaaaaggtatggtggggatatttttaaaaactccttttggtttacctggggatccaattgatgtatatgtttatatactgggttcttgttttatatacctggcttttactttattaatatgagttactgaaggtgatggaggtatttgaaaattttacttccataggacatactgcatgtaagccaagtcatggagaatctgctgcatagctctattttaaagtaaaagtctaccaccgaatccctagtccccctgttttctgtttcttcttgtgattgctgccataattctaagttatttacttttaccactatttaagttatcaactttagctagtatcttcaaactttcactttgaaaaatgagaattttatattctaagccagttttcattttggttttgtgttttggttaataaaacaatactcaaatacaaaa

SEQ ID NO: 118 - DNA, 2029 bp, Homo sapiens
ggcgtgctgcggcggaacggctgttggtttctgctgggtgtaggtccttggctggtcgggcctccggtgttctgcttctccccgctgagctgctgcctggtgaagaggaagccatggcgctccgagtcaccaggaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgaggaagagcaagcagtcagaccaaaatacctactgggtcgggaagtcactggaaacatgagagccatcctaattgactggctagtacaggttcaaatgaaattcaggttgttgcaggagaccatgtacatgactgtctccattattgatcggttcatgcagaataattgtgtgcccaagaagatgctgcagctggttggtgtcactgccatgtttattgcaagcaaatatgaagaaatgtaccctccagaaattggtgactttgcttttgtgactgacaacacttatactaagcaccaaatcagacagatggaaatgaagattctaagagctttaaactttggtctgggtcggcctctacctttgcacttccttcggagagcatctaagattggagaggttgatgtcgagcaacatactttggccaaatacctgatggaactaactatgttggactatgacatggtgcactttcctccttctcaaattgcagcaggagctttttgcttagcactgaaaattctggataatggtgaatggacaccaactctacaacattacctgtcatatactgaagaatctcttcttccagttatgcagcacctggctaagaatgtagtcatggtaaatcaaggacttacaaagcacatgactgtcaagaacaagtatgccacatcgaagcatgctaagatcagcactctaccacagctgaattctgcactagttcaagatttagccaaggctgtggcaaaggtgtaacttgtaaacttgagttggagtactatatttacaaataaaattggcaccatgtgccatctgtacatattactgttgcatttacttttaataaagcttgtggccccttttacttttttatagcttaactaatttgaatgtggttacttcctactgtagggtagcggaaaagttgtcttaaaaggtatggtggggatatttttaaaaactccttttggtttacctggggatccaattgatgtatatgtttatatactgggttcttgttttatatacctggcttttactttattaatatgagttactgaaggtgatggaggtatttgaaaattttacttccataggacatactgcatgtaagccaagtcatggagaatctgctgcatagctctattttaaagtaaaagtctaccaccgaatccctagtccccctgttttctgtttcttcttgtgattgctgccataattctaagttatttacttttaccactatttaagttatcaactttagctagtatcttcaaactttcactttgaaaaatgagaattttatattctaagccagttttcattttggttttgtgttttggttaataaaacaatactcaaatacaaaa

SEQ ID NO: 119 - DNA, 2058 bp, Homo sapiens
cgaacgccttcgcgcgatcgccctggaaacgcattctctgcgaccggcagccgccaatgggaagggagtgagtgccacgaacaggccaataaggagggagcagtgcggggtttaaatctgaggctaggctggctcttctcggcgtgctgcggcggaacggctgttggtttctgctgggtgtaggtccttggctggtcgggcctccggtgttctgcttctccccgctgagctgctgcctggtgaagaggaagccatggcgctccgagtcaccaggaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgaggaagagcaagcagtcagaccaaaatacctactgggtcgggaagtcactggaaacatgagagccatcctaattgactggctagtacaggttcaaatgaaattcaggttgttgcaggagaccatgtacatgactgtctccattattgatcggttcatgcagaataattgtgtgcccaagaagatgctgcagctggttggtgtcactgccatgtttattgcaagcaaatatgaagaaatgtaccctccagaaattggtgactttgcttttgtgactgacaacacttatactaagcaccaaatcagacagatggaaatgaagattctaagagctttaaactttggtctgggtcggcctctacctttgcacttccttcggagagcatctaagattggagaggttgatgtcgagcaacatactttggccaaatacctgatggaactaactatgttggactatgacatggtgcactttcctccttctcaaattgcagcaggagctttttgcttagcactgaaaattctggataatggtgaatggactgtcaagaacaagtatgccacatcgaagcatgctaagatcagcactctaccacagctgaattctgcactagttcaagatttagccaaggctgtggcaaaggtgtaacttgtaaacttgagttggagtactatatttacaaataaaattggcaccatgtgccatctgtacatattactgttgcatttacttttaataaagcttgtggccccttttacttttttatagcttaactaatttgaatgtggttacttcctactgtagggtagcggaaaagttgtcttaaaaggtatggtggggatatttttaaaaactccttttggtttacctggggatccaattgatgtatatgtttatatactgggttcttgttttatatacctggcttttactttattaatatgagttactgaaggtgatggaggtatttgaaaattttacttccataggacatactgcatgtaagccaagtcatggagaatctgctgcatagctctattttaaagtaaaagtctaccaccgaatccctagtccccctgttttctgtttcttcttgtgattgctgccataattctaagttatttacttttaccactatttaagttatcaactttagctagtatcttcaaactttcactttgaaaaatgagaattttatattctaagccagttttcattttggttttgtgttttggttaataaaacaatactcaaatacaaaa

SEQ ID NO: 120 - DNA, 2828 bp, Homo sapiens
cgcacgcgcggttagtagtcgctgctgcgcggccgccggcgggactggtctgaagagacgcggggaccaagtggcaacgacttggacatctgagctgtcactgccgaaaacaggccgcaagagagcatctgcccaagcaacaaagaggaggtgtttgcttgggagttaaaagcaaatggcaaccaaagctcaggactgggagagaaaagataatcaatatgcatttccaagccttttggctatgtttgggtcttctgttcatctcaattaatgcagaatttatggatgatgatgttgagacggaagactttgaagaaaattcagaagaaattgatgttaatgaaagtgaactttcctcagagattaaatataagacacctcaacctataggagaagtatattttgcagaaacttttgatagtggaaggttggctggatgggtcttatcaaaagcaaagaaagatgacatggatgaggaaatttcaatatacgatggaagatgggaaattgaagagttgaaagaaaaccaggtacctggtgacagaggactggtattaaaatctagagcaaagcatcatgcaatatctgctgtattagcaaaaccattcatttttgctgataaacccttgatagttcaatatgaagtaaattttcaagatggtattgattgtggaggtgcatacattaaactcctagcagacactgatgatttgattctggaaaacttttatgataaaacatcctatatcattatgtttggaccagataaatgtggagaagattataaacttcattttatcttcagacataaacatcccaaaactggagttttcgaagagaaacatgccaaacctccagatgtagaccttaaaaagttctttacagacaggaagactcatctttatacccttgtgatgaatccagatgacacatttgaggtgttagttgatcaaacagttgtaaacaaaggaagcctcctagaggatgtggttcctcctatcaaacctcccaaagaaattgaagatcccaatgataaaaaacctgaggaatgggatgaaagagcaaaaattcctgatccttctgccgtcaaaccagaagactgggatgaaagtgaacctgcccaaatagaagattcaagtgttgttaaacctgctggctggcttgatgatgaaccaaaatttatccctgatcctaatgctgaaaaacctgatgactggaatgaagacacggatggagaatgggaggcacctcagattcttaatccagcatgtcggattgggtgtggtgagtggaaacctcccatgatagataacccaaaatacaaaggagtatggagacctccactggtcgataatcctaactatcagggaatctggagtcctcgaaaaattcctaatccagattatttcgaagatgatcatccatttcttctgacttctttcagtgctcttggtttagagctttggtctatgacctctgatatctactttgataattttattatctgttcggaaaaggaagtagcagatcactgggctgcagatggttggagatggaaaataatgatagcaaatgctaataagcctggtgtattaaaacagttaatggcagctgctgaagggcacccatggctttggttgatttatcttgtgacagcaggagtgccaatagcattaattacttcattttgttggccaagaaaagtaaagaaaaaacataaagatacagagtataaaaaaaccgacatatgtataccacaaacaaaaggagtactagagcaagaagaaaaggaagagaaagcagccctggaaaaaccaatggacctggaagaggaaaaaaagcaaaatgatggtgaaatgcttgaaaaagaagaggaaagtgaacctgaggaaaagagtgaagaagaaattgaaatcatagaagggcaagaagaaagtaatcaatcaaataagtctgggtcagaggatgagatgaaagaagcagatgagagcacaggatctggagatgggccgataaagtcagtacgcaaaagaagagtacgaaaggactaaactagattgaaatatttttaattcccgagagggatgtttggcattgtaaaaatcagcatgccagacctgaactttaatcagtctgcacatcctgtttctaatatctagcaacattatattctttcagacatttattttagtccttcatttcagaggaaaaagaagcaactttgaagttacctcatctttgaatttagaataaaagtggcacattacatatcggatctaagagattaataccattagaagttacacagttttagttgtttggagatagttttggtttgtacagaacaaaataatatgtagcagcttcattgctattggaaaaatcagttattggaatttccacttaaatggctatacaacaatataactggtagttctataataaaaatgagcatatgttctgttgtgaagagctaaatgcaataaagtttctgtatggttgtttgattctatcaacaattgaaagtgttgtatatgacccacatttacctagtttgtgtcaaattatagttacagtgagttgtttgcttaaattatagattcctttaaggacatgccttgttcataaaatcactggattatattgcagcatattttacatttgaatacaaggataatgggttttatcaaaacaaaatgatgtacagattttttttcaagtttttatagttgctttatgccagagtggtttaccccattcacaaaatttcttatgcatacattgctattgaaaataaaatttaaatattttttcatcctgaaaaaaaa

SEQ ID NO: 121 - DNA, 2725 bp, Homo sapiens
agtagtcgctgctgcgcggccgccggcgggactggtctgaagagacgcggggaccaagtggcaacgacttggacatctgagctgtcactgccgaaaacaggccgcaagagagataatcaatatgcatttccaagccttttggctatgtttgggtcttctgttcatctcaattaatgcagaatttatggatgatgatgttgagacggaagactttgaagaaaattcagaagaaattgatgttaatgaaagtgaactttcctcagagattaaatataagacacctcaacctataggagaagtatattttgcagaaacttttgatagtggaaggttggctggatgggtcttatcaaaagcaaagaaagatgacatggatgaggaaatttcaatatacgatggaagatgggaaattgaagagttgaaagaaaaccaggtacctggtgacagaggactggtattaaaatctagagcaaagcatcatgcaatatctgctgtattagcaaaaccattcatttttgctgataaacccttgatagttcaatatgaagtaaattttcaagatggtattgattgtggaggtgcatacattaaactcctagcagacactgatgatttgattctggaaaacttttatgataaaacatcctatatcattatgtttggaccagataaatgtggagaagattataaacttcattttatcttcagacataaacatcccaaaactggagttttcgaagagaaacatgccaaacctccagatgtagaccttaaaaagttctttacagacaggaagactcatctttatacccttgtgatgaatccagatgacacatttgaggtgttagttgatcaaacagttgtaaacaaaggaagcctcctagaggatgtggttcctcctatcaaacctcccaaagaaattgaagatcccaatgataaaaaacctgaggaatgggatgaaagagcaaaaattcctgatccttctgccgtcaaaccagaagactgggatgaaagtgaacctgcccaaatagaagattcaagtgttgttaaacctgctggctggcttgatgatgaaccaaaatttatccctgatcctaatgctgaaaaacctgatgactggaatgaagacacggatggagaatgggaggcacctcagattcttaatccagcatgtcggattgggtgtggtgagtggaaacctcccatgatagataacccaaaatacaaaggagtatggagacctccactggtcgataatcctaactatcagggaatctggagtcctcgaaaaattcctaatccagattatttcgaagatgatcatccatttcttctgacttctttcagtgctcttggtttagagctttggtctatgacctctgatatctactttgataattttattatctgttcggaaaaggaagtagcagatcactgggctgcagatggttggagatggaaaataatgatagcaaatgctaataagcctggtgtattaaaacagttaatggcagctgctgaagggcacccatggctttggttgatttatcttgtgacagcaggagtgccaatagcattaattacttcattttgttggccaagaaaagtaaagaaaaaacataaagatacagagtataaaaaaaccgacatatgtataccacaaacaaaaggagtactagagcaagaagaaaaggaagagaaagcagccctggaaaaaccaatggacctggaagaggaaaaaaagcaaaatgatggtgaaatgcttgaaaaagaagaggaaagtgaacctgaggaaaagagtgaagaagaaattgaaatcatagaagggcaagaagaaagtaatcaatcaaataagtctgggtcagaggatgagatgaaagaagcagatgagagcacaggatctggagatgggccgataaagtcagtacgcaaaagaagagtacgaaaggactaaactagattgaaatatttttaattcccgagagggatgtttggcattgtaaaaatcagcatgccagacctgaactttaatcagtctgcacatcctgtttctaatatctagcaacattatattctttcagacatttattttagtccttcatttcagaggaaaaagaagcaactttgaagttacctcatctttgaatttagaataaaagtggcacattacatatcggatctaagagattaataccattagaagttacacagttttagttgtttggagatagttttggtttgtacagaacaaaataatatgtagcagcttcattgctattggaaaaatcagttattggaatttccacttaaatggctatacaacaatataactggtagttctataataaaaatgagcatatgttctgttgtgaagagctaaatgcaataaagtttctgtatggttgtttgattctatcaacaattgaaagtgttgtatatgacccacatttacctagtttgtgtcaaattatagttacagtgagttgtttgcttaaattatagattcctttaaggacatgccttgttcataaaatcactggattatattgcagcatattttacatttgaatacaaggataatgggttttatcaaaacaaaatgatgtacagattttttttcaagtttttatagttgctttatgccagagtggtttaccccattcacaaaatttcttatgcatacattgctattgaaaataaaatttaaatattttttcatcctgaa

SEQ ID NO: 122 - DNA, 3108 bp, Homo sapiens
actcccacgcgcctccgccccgccagcctcatttctggcgcgctctccccgtggctccgcaagatggcggcgggcctgctgagggacttgccttcttaaacttcgagggccggagcttccttaggaagtggttccctcctggtccctgtacttggtggggtgggcggggttcgtgggggcctcagcgtggggtgtggggcgtcctgaaggcatggccctgtagctgagggggctgggccggaagtgcctctggtcccctcgcgcctgtcagctgcgggggacttgctgatggcggctccctcgtgtggcggcgacagaaaagctcgcctgacgccatctttgccgcacgagtctactgcaaatcctgaaactccaaactcaaccatctccagagaggccagcacccagtcctcatcagctgcaaccagccaaggctatattttaccagaaggcaaaatcatgccaaacactgtttttgttggaggaattgatgttaggatggatgaaactgagattagaagcttctttgctagatatggttcagtgaaagaagtgaagataatcactgatcgaactggtgtgtccaaaggctatggatttgtttcattttttaatgacgtggatgtgcagaagatagtagaatcacagataaatttccatggtaaaaagctgaagctgggccctgcaatcaggaaacaaaatttatgtgcttatcatgtgcagccacgtcctttggtttttaatcatcctcctccaccacagtttcagaatgtctggactaatccaaacactgaaacttatatgcagcccacaaccacgatgaatcctataactcagtatgttcaggcatatcctacttacccaaattcaccagttcaggtcatcactggatatcagttgcctgtatataattatcagatgccaccacagtggcctgttggggagcaaaggagctatgttgtacctccggcttattcagctgttaactaccactgtaatgaagttgatccaggagctgaagttgtgccaaatgaatgttcagttcatgaagctactccaccctctggaaatggcccacaaaagaaatctgtggaccgaagcatacaaacggtggtatcttgtctgtttaatccagagaacagactgagaaactctgttgttactcaagatgactacttcaaggataaaagagtgcatcactttagaagaagtcgggcaatgcttaaatctgtttgatcctcctggcttatctagttacatgggaagttgctggttttgaatattaagctaaaaggtttccactattatagaaattctgaattttggtaaatcacactcaaactttgtgtataagttgtattattagactctctagttttatcttaaactgttcttcattagatgtttatttagaaactggttctgtgttgaaatatagttgaaagtaaaaaaataattgagactgaaagaaactaagatttatctgcaaggattttttaaaaattggcattttaagtgtttaaaagcaaatactgattttcaaaaaaatgtttttaaaaacctattttgaaaggtcagaattttgttggtctgaatacaaacatttcacttctccaacaagtacctgtgaacagtacagtatttacagtattgagctttgcatttatgatttctccagaaatttaccacaaaagcaaaatttttaaaactgcatttttaatcagtggaactcaatatatagttagctttattgaagtcttcttatctaaacccagcaaaacagattcaaagcgaacagtccaatcagtgggtcatatgtttattcaaaatattttatcttttagctagaatccacacatatatatcctatttgattagggtagtaattaggataactaaaattctgggcctaattttttaaagaatccaagacaaactaaactttactaggtacataagcttctcaatgagtcaccattcttcttttttgtaaaaacttttttctttgaaatgctaaacttggctgtatgtcaaattgtgcaaaatattggtattaaagaatgctgcaacttttttatgtctcttagaggttaatcagagtatctgaagggaattgtttttataaaaacattgaaatattagttacttgctataaatagatttagtctgttatatttccttttgtaaagtaaaatatgtccagaagagtcaaagtagttagttttggttatttctaaaccacaaaagttgtttaataagtatatcttaagaatgtgctagagttaaaagttagcattgtttctagattagctggtgtcttcattttacattgtgacaaacagctagagcatcagagcccttttgctataccacagtctttcgtttccagcctttgtcactagtctttgaggaggtttgctcctagaactggtgatataaagaatgaaagtagctgtatgagcagagcagttcaagggccaaaccctggaacggtagcaatgggatataatacctttctaagggaaaaagttgtatcagtaccatttgatctgccatggacatgagtttaaagcggctttctggcccttctttcagtgacttcttccctaaaatgtagaaattctaacttaatgtagttactgtgagccatattactagtgccccctagggtctataattccttaaaattttcattctgaatctgaaggagagagtcttttaactttagaattcccaagagggctttattacacctcagaaattgaaagcactatgaatttgtccatttaaaaatgatctgtagtttttttggtgctataacattctgacacatatcattctgtgattaaatctccagcttactataaatgatatctatattctaaagagctacttctaattattccaatatgaccttaaggaaaagtaagggaataaatttttgtctttgttggagtgaagcatttaaaagagtaagggtaaaaaagataaagtcctgaacctttcaaaatggaaaattaattctaaacttagaaatatgcttctgcctattgctgatactgtctttgcatacatgaataaaaataaagtttttttcttcaaaaaaaa

SEQ ID NO: 123 - DNA, 3054 bp, Homo sapiens
attggctgaggccgataccacgcgccccgatacccggcgcaggagccacctccctgagccccgcggaccacgcctcagtccgcctgcgctcctcagcctgacggtccgcctttcggggctcctcagccttgtcacccgctcttggttttccttttctcttcatctttggctcctttgaccactcgaagccgcgcagcgggttccagcggacctcacagcagccccagaagtggtgcgccaagcacagcctctgctcctcctggagccggtcgggaactgctgcctgccgccatcatgtctactgcaaatcctgaaactccaaactcaaccatctccagagaggccagcacccagtcctcatcagctgcaaccagccaaggctatattttaccagaaggcaaaatcatgccaaacactgtttttgttggaggaattgatgttaggatggatgaaactgagattagaagcttctttgctagatatggttcagtgaaagaagtgaagataatcactgatcgaactggtgtgtccaaaggctatggatttgtttcattttttaatgacgtggatgtgcagaagatagtagaatcacagataaatttccatggtaaaaagctgaagctgggccctgcaatcaggaaacaaaatttatgtgcttatcatgtgcagccacgtcctttggtttttaatcatcctcctccaccacagtttcagaatgtctggactaatccaaacactgaaacttatatgcagcccacaaccacgatgaatcctataactcagtatgttcaggcatatcctacttacccaaattcaccagttcaggtcatcactggatatcagttgcctgtatataattatcagatgccaccacagtggcctgttggggagcaaaggagctatgttgtacctccggcttattcagctgttaactaccactgtaatgaagttgatccaggagctgaagttgtgccaaatgaatgttcagttcatgaagctactccaccctctggaaatggcccacaaaagaaatctgtggaccgaagcatacaaacggtggtatcttgtctgtttaatccagagaacagactgagaaactctgttgttactcaagatgactacttcaaggataaaagagtgcatcactttagaagaagtcgggcaatgcttaaatctgtttgatcctcctggcttatctagttacatgggaagttgctggttttgaatattaagctaaaaggtttccactattatagaaattctgaattttggtaaatcacactcaaactttgtgtataagttgtattattagactctctagttttatcttaaactgttcttcattagatgtttatttagaaactggttctgtgttgaaatatagttgaaagtaaaaaaataattgagactgaaagaaactaagatttatctgcaaggattttttaaaaattggcattttaagtgtttaaaagcaaatactgattttcaaaaaaatgtttttaaaaacctattttgaaaggtcagaattttgttggtctgaatacaaacatttcacttctccaacaagtacctgtgaacagtacagtatttacagtattgagctttgcatttatgatttctccagaaatttaccacaaaagcaaaatttttaaaactgcatttttaatcagtggaactcaatatatagttagctttattgaagtcttcttatctaaacccagcaaaacagattcaaagcgaacagtccaatcagtgggtcatatgtttattcaaaatattttatcttttagctagaatccacacatatatatcctatttgattagggtagtaattaggataactaaaattctgggcctaattttttaaagaatccaagacaaactaaactttactaggtacataagcttctcaatgagtcaccattcttcttttttgtaaaaacttttttctttgaaatgctaaacttggctgtatgtcaaattgtgcaaaatattggtattaaagaatgctgcaacttttttatgtctcttagaggttaatcagagtatctgaagggaattgtttttataaaaacattgaaatattagttacttgctataaatagatttagtctgttatatttccttttgtaaagtaaaatatgtccagaagagtcaaagtagttagttttggttatttctaaaccacaaaagttgtttaataagtatatcttaagaatgtgctagagttaaaagttagcattgtttctagattagctggtgtcttcattttacattgtgacaaacagctagagcatcagagcccttttgctataccacagtctttcgtttccagcctttgtcactagtctttgaggaggtttgctcctagaactggtgatataaagaatgaaagtagctgtatgagcagagcagttcaagggccaaaccctggaacggtagcaatgggatataatacctttctaagggaaaaagttgtatcagtaccatttgatctgccatggacatgagtttaaagcggctttctggcccttctttcagtgacttcttccctaaaatgtagaaattctaacttaatgtagttactgtgagccatattactagtgccccctagggtctataattccttaaaattttcattctgaatctgaaggagagagtcttttaactttagaattcccaagagggctttattacacctcagaaattgaaagcactatgaatttgtccatttaaaaatgatctgtagtttttttggtgctataacattctgacacatatcattctgtgattaaatctccagcttactataaatgatatctatattctaaagagctacttctaattattccaatatgaccttaaggaaaagtaagggaataaatttttgtctttgttggagtgaagcatttaaaagagtaagggtaaaaaagataaagtcctgaacctttcaaaatggaaaattaattctaaacttagaaatatgcttctgcctattgctgatactgtctttgcatacatgaataaaaataaagtttttttcttcaaaaaaaa

SEQ ID NO: 124 - DNA, 2269 bp, Homo sapiens
gccaaaccctgtggtcaacggcgcgcgggtctccaggctccgtgttctaggcccgagttagaatcctgtcagctgaggaggtcgggcggggcagaggggcttcaccttgaaaatctcggggagactgtgggtacgagggggaagtgattatttttctgttgcccacttttcaatatgaaggaggatcaagttgtggcggaagaaccaggattccaagatgaagaggaatctttgtttcaagatattgacctgttacagaaacatggaattaacgtggctgacattaagaaactgaaatcagtaggaatctgtaccatcaaaggtatacagatgacaacaagaagagctctatgcaatgtcaaaggactctcagaagccaaagtagacaagattaaagaggcagcgaacaaactaattgaaccaggattcttgactgcatttgagtatagtgaaaagaggaaaatggttttccatatcaccaccgggagccaggaatttgataagttactaggaggtggaattgaaagtatggcaattacagaagcttttggagaatttcgtactggaaaaacccagctttctcataccctctgtgtgacagctcaacttccaggagctggtggctacccaggaggaaagattatcttcattgatacagaaaatactttccgtccagatcgccttagggacattgctgatcgctttaatgtagaccatgatgcagtactggacaacgtactttatgcacgtgcatatactagtgaacatcagatggagctacttgattatgtagcagcaaagttccatgaagaagctggcatcttcaagctattgattatcgattcaataatggcactttttcgagtggatttcagtggccgtggggagttggccgaacggcagcaaaaattggcccagatgttgtcacgactccaaaaaatctcagaagaatataacgtggctgtttttgtgaccaatcaaatgactgccgatccaggagcaactatgacctttcaggcagatcccaaaaaacccattgggggacacattctggctcatgcttcaacaacaagaataagcttgcgaaagggaagaggagagctcagaattgccaagatttatgacagtcctgagatgcctgaaaatgaagccaccttcgcaataactgctggaggaattggggatgccaaggagtaggtggtgaattgatgcaaattgcttcttagtgcttattaggagctgaagaaatggaaaagcagtctccaatttcacatcttgaaatagaggttttttcccacatgttactaaagaaaagtcagcaaagagatttaaatcttatatttatcttaaaagtccctgatttatgataactatacattgtatgtaaattcagggatatgtatatgtatgtttgtgtgtgtgtgtgtttgtgtgtgtatacctgacatatatagtagatatatatacctattgaaattctctcactctgtgtatgtatatatacctatggaaaactagttgttgggaaaggagtacgtgattccctccctttcacttttcaaagtgagccactaaacagaaagtctaagagttcagaaatgtcccattctcctaaggactttcccttcaccatttttctagggtatagtgccactgacttacatagctagatgtttttccacaagaggatttaagggaggaatgtttataggacacacacacaaaagctctttctatttataatatcaaactgcatattcacctttatagcaacagaaaacagacattaaattaagccaaattttaaatcatttgactttgacaagcagaaattacttttaaaaaatgtatttatggctgggcgtggtggctcacacctgtaatcccagcactttgggaggccgaggcaggtggatcacttgaggtcaggagttcaagaccagcctggccaacatggagaaaccccatctctactaaaaatacaaaaattagccaagtgcagtggcatgtgcttgtaatcccagctactctggaggctgaggcaggagaattgcttgaacccaggaggcagagattgcggtgagccaagatggcaccactgcactccagcctaggtgacagagtgagactccgtctcaaaaaaaaaaaaaaaacttttttaaaatgttaaaattaatttaaatgtaaaatttctgaatactaatcttagaaatgtgtaaaagatattattttgattgttaaacaaataaaatcctgttttcaaaatgca

SEQ ID NO: 125 - DNA, 2116 bp, Homo sapiens
ctcctcgtttggcgccaaaccctgtggtcaacggcgcgcgggtctccaggctccgtgttctaggcccgagttagaatcctgtcagctgaggaggtcgggcggggcagaggggcttcaccttgaaaatctcggggagactgtgggtacgagggggaagtgattatttttctgttgcccacttttcaatatgaaggaggatcaagttgtggcggaagaaccaggattccaagatgaagaggaatctttgtttcaagatattgacctgttacagaaacatggaattaacgtggctgacattaagaaactgaaatcagtaggaatctgtaccatcaaaggtatacagatgacaacaagaagagctctatgcaatgtcaaaggactctcagaagccaaagtagacaagattaaagaggcagcgaacaaactaattgaaccaggattcttgactgcatttgagtatagtgaaaagaggaaaatggttttccatatcaccaccgggagccaggaatttgataagttactaggaggtggaattgaaagtatggcaattacagaagcttttggagaatttcgtactggaaaaacccagctttctcataccctctgtggtgaacatcagatggagctacttgattatgtagcagcaaagttccatgaagaagctggcatcttcaagctattgattatcgattcaataatggcactttttcgagtggatttcagtggccgtggggagttggccgaacggcagcaaaaattggcccagatgttgtcacgactccaaaaaatctcagaagaatataacgtggctgtttttgtgaccaatcaaatgactgccgatccaggagcaactatgacctttcaggcagatcccaaaaaacccattgggggacacattctggctcatgcttcaacaacaagaataagcttgcgaaagggaagaggagagctcagaattgccaagatttatgacagtcctgagatgcctgaaaatgaagccaccttcgcaataactgctggaggaattggggatgccaaggagtaggtggtgaattgatgcaaattgcttcttagtgcttattaggagctgaagaaatggaaaagcagtctccaatttcacatcttgaaatagaggttttttcccacatgttactaaagaaaagtcagcaaagagatttaaatcttatatttatcttaaaagtccctgatttatgataactatacattgtatgtaaattcagggatatgtatatgtatgtttgtgtgtgtgtgtgtttgtgtgtgtatacctgacatatatagtagatatatatacctattgaaattctctcactctgtgtatgtatatatacctatggaaaactagttgttgggaaaggagtacgtgattccctccctttcacttttcaaagtgagccactaaacagaaagtctaagagttcagaaatgtcccattctcctaaggactttcccttcaccatttttctagggtatagtgccactgacttacatagctagatgtttttccacaagaggatttaagggaggaatgtttataggacacacacacaaaagctctttctatttataatatcaaactgcatattcacctttatagcaacagaaaacagacattaaattaagccaaattttaaatcatttgactttgacaagcagaaattacttttaaaaaatgtatttatggctgggcgtggtggctcacacctgtaatcccagcactttgggaggccgaggcaggtggatcacttgaggtcaggagttcaagaccagcctggccaacatggagaaaccccatctctactaaaaatacaaaaattagccaagtgcagtggcatgtgcttgtaatcccagctactctggaggctgaggcaggagaattgcttgaacccaggaggcagagattgcggtgagccaagatggcaccactgcactccagcctaggtgacagagtgagactccgtctcaaaaaaaaaaaaaaaacttttttaaaatgttaaaattaatttaaatgtaaaatttctgaatactaatcttagaaatgtgtaaaagatattattttgattgttaaacaaataaaatcctgttttcaaaatgc

SEQ ID NO: 126 - DNA, 2082 bp, Homo sapiens
ctcatctttccaagctaaatgcttctcttactgtccttctagtccttgttgactttgaaatgaaatcagaggcccctggacaaaggactacttcttacataatatttcttattttcccagaagtgattatttttctgttgcccacttttcaatatgaaggaggatcaagttgtggcggaagaaccaggattccaagatgaagaggaatctttgtttcaagatattgacctgttacagaaacatggaattaacgtggctgacattaagaaactgaaatcagtaggaatctgtaccatcaaaggtatacagatgacaacaagaagagctctatgcaatgtcaaaggactctcagaagccaaagtagacaagattaaagaggcagcgaacaaactaattgaaccaggattcttgactgcatttgagtatagtgaaaagaggaaaatggttttccatatcaccaccgggagccaggaatttgataagttactaggaggtggaattgaaagtatggcaattacagaagcttttggagaatttcgtactggaaaaacccagctttctcataccctctgtggtgaacatcagatggagctacttgattatgtagcagcaaagttccatgaagaagctggcatcttcaagctattgattatcgattcaataatggcactttttcgagtggatttcagtggccgtggggagttggccgaacggcagcaaaaattggcccagatgttgtcacgactccaaaaaatctcagaagaatataacgtggctgtttttgtgaccaatcaaatgactgccgatccaggagcaactatgacctttcaggcagatcccaaaaaacccattgggggacacattctggctcatgcttcaacaacaagaataagcttgcgaaagggaagaggagagctcagaattgccaagatttatgacagtcctgagatgcctgaaaatgaagccaccttcgcaataactgctggaggaattggggatgccaaggagtaggtggtgaattgatgcaaattgcttcttagtgcttattaggagctgaagaaatggaaaagcagtctccaatttcacatcttgaaatagaggttttttcccacatgttactaaagaaaagtcagcaaagagatttaaatcttatatttatcttaaaagtccctgatttatgataactatacattgtatgtaaattcagggatatgtatatgtatgtttgtgtgtgtgtgtgtttgtgtgtgtatacctgacatatatagtagatatatatacctattgaaattctctcactctgtgtatgtatatatacctatggaaaactagttgttgggaaaggagtacgtgattccctccctttcacttttcaaagtgagccactaaacagaaagtctaagagttcagaaatgtcccattctcctaaggactttcccttcaccatttttctagggtatagtgccactgacttacatagctagatgtttttccacaagaggatttaagggaggaatgtttataggacacacacacaaaagctctttctatttataatatcaaactgcatattcacctttatagcaacagaaaacagacattaaattaagccaaattttaaatcatttgactttgacaagcagaaattacttttaaaaaatgtatttatggctgggcgtggtggctcacacctgtaatcccagcactttgggaggccgaggcaggtggatcacttgaggtcaggagttcaagaccagcctggccaacatggagaaaccccatctctactaaaaatacaaaaattagccaagtgcagtggcatgtgcttgtaatcccagctactctggaggctgaggcaggagaattgcttgaacccaggaggcagagattgcggtgagccaagatggcaccactgcactccagcctaggtgacagagtgagactccgtctcaaaaaaaaaaaaaaaacttttttaaaatgttaaaattaatttaaatgtaaaatttctgaatactaatcttagaaatgtgtaaaagatattattttgattgttaaacaaataaaatcctgttttcaaaatgc

SEQ ID NO: 127 - DNA, 14639 bp, Homo sapiens
cccggggcagcgcaaccgctggggccggcctcagtgggctgagtggtcggggcatcggggcccagagagcggctggtttcgaagtataaagcattccgcacgacgggggatggagaaggatgctgaagatggcgccccttctgagggagcagaggctcctccctctacggaagaggctgcccctccccgttcagaagaggaagaggccccgcgccctccgacagtggaggccccggcagaagatggtttctctccttccgcagaagatgctgtttcttctgtggtggattatcgggatctcattccttctgaagaagggatagttcttccagatgatcatgaagcggatctgaatagagttcgacagaggcttgcaccgcgaccggttcagtcagtgatttcggaagtgctgtccttgccgtcttcccggaggtcctccagataccgccggagtatgagtggccttcccaatctacaggaaacattaaaagagagacaggcaagatttagagaggcaagggaaagccgaagactgaaaattgacccttcatacaaatatatatttgaaattctagcagaaaatcttggcctggacatagtaactgttgaagaattaattttggattgcccatctctggaagcatttactaatttttttgcgaaagatggttgtaagacactgaaatttttgtaccaagaaggagatgtacctggtattgaatgtggtcgaactattgctggagcaactaaaggggcaaaaatgatgaaattgtatatagacaatgcagccccggataaactaaaaggactgtgcatattttttgttcgttgccgtaatgatgttgctataaatgttaaaactattcaagaggaagcgctctttactgttctggatgcgtcgaaaggactcttaaatggaattagggatatgttggcaaatatatttctaccagctgttcttgcaacaaacaactggggtgctttaaaccagtccaagcagggagaatctgaaaaacatattttcactgaaaccatcaacagatatctttcatttttagatggtgctagaataagtattgagggaacagtgaagttaaagacaatagacaatgttaatttttccaaactgcacacctttgaagaagtaactgctgcagccagcaactcagaaactgttcatcagctggaggaagtgctgatggtatggtacaaacagatcgaacaggtacttattgagagtgagcagatgagaaaagaagctggtgattcaggtccactcactgaattggaacactggaaacgcatgtcagccaagttcaactatatcattgagcagattaaagggccaagttgtaaggctgtcataaatgtgctaaatgttgcacactccaaactgctaaagaattggcgtgatttggatgcaagaatcactgatacagcaaatgaatccaaagataatgtcagatatttgtatactttggaaaaagtgtgtcaacctctctataaccatgacctagtttccatggcacatggaatacaaaatttgattaatgccatcagaatgattcacggtgtgtcaaggtattataatacctcagagagaatgacctcattgtttatcaaggtaacaaatcaaatggtaacagcatgtaaagcatatattactgatggaggattaaaccatgtatgggatcaggaaacgccagttgtactaaagaaaattcaggactgcatttttctattcaaggaatatcaggcatcttttcataaaacaaggaaactgatttcagaatcctcaggggaaaaatcttttgaggtttcagaaatgtatatatttggaaaatttgaagctttttgcaaaagactggagaagattacagaaatgataactgttgtgcaaacatattcaaccttgagtaattctaccatagaaggaatagatattatggcaataaaattcagaaatatataccaaggggttaagaaaaagcaatatgacattctggatccaagaaggacagaatttgacacagatttcttagatttcatgacaaaaatcaatggtttagaggtacaaatacaggcatttatgaacagtagttttgggaaaatcttatcttctcagcaggctcttcagctacttcaaaggtttcagaagctgaacattccctgtctgggattagaaataaaccacacaatagagcgtattcttcagtactatgtggctgaacttgatgctactaagaagctttatcattctcagaaagatgacccccctcttgctcgcaacatgccccctatagcaggaaaaatactctgggtgaggcagctctatcgccggataagtgagcccatcaattatttctttaaaaactcagacattttatcaagtccggacggtaaagctgtcatccgtcagtataacaagatctcctatgtgctggtggaattcgaggtggtctatcacacagcctggatcagagagatttcacagttgcattacgctttacaagccacgctttttgtgcgacatccagaaacagggaagttgctggttaatttcgatcccaaaattttggaagttgttcgggaaactaagtgtatgataaaaatgaagttggatgtaccagaacaggcaaagagattgctaaaattggaaagtaaattgaaagcagacaaactgtatttgcagggtcttctgcaatattatgatgagttatgtcaggaagtgccttctgtgtttgtcaatctgatgaccccaaaaatgaaaaaggtggaatctgtgttgaggcaaggactcacagtgttaacatggtcgtctttaacactggaaagcttctttcaagaagtcgaattagttttggatatgttcaatcaacttttaaagaagatcagtgacttgtgtgaaatgcatattgatacagttctgaaggagatagccaaaactgtgttgatttctctgcctgaaagtggtgctaccaaagtagaagatatgttgaccctcaatgagacatacacaaaagaatgggctgacattctaaaccacaaaagtaagcatgtggaagaagctgtcagagaacttatatcaatatttgagcagatttatgaagtgaaatacactgggaaagtaggaaaacagtcagaacagcggaaacacgttgtttttggaagtgaaacaggagagggtgaaaacaatgactatgaagctaatattgtgaatgagtttgatactcatgataaagaagatgaatttaaaaaggagtgtaaagaggtctttgcttttttctctcatcaattactagacagtcttcaaaaagctacacggttatctctggacacaatgaaaagaagaatatttgttgcaagcctttatgggcgaaagcagtcagaagatattatttcctttataaaaagtgaagtacatcttgcaattcctaatgtggtgatgattcctagtttggatgacattcaacaagccattaaccgtatgatccagttaaccctggaggtcagcagaggagtggctcactgggggcaacagcaaatccgtcccatcaagtctgtcattcccagccccaccactactgacgtgacccatcaaaacacaggaaaactgctgaagaaggaagaaagatcttttgaagaagctattcctgcgaggaagctgaagaatttttacccgggggtagcggagcacaaggatatttctaagttggtcctgctcctttcttcctctgtaaattccctaagaaaggcagctcatgaggccctgcaggactttcagaagtacaagactctctggacagaggaccgcgatgtgaaagtgaaggaatttttggctaacaacccctctctgactgaaatcagatcagaaattctacactatgctacttttgaacaggagattgatgagttgaagcctattattgttgtaggagcacttgaattacatacagagccgatgaaattggccttatccatcgaggccaaggcatggaagatgttactctgtcgatatctgaatgaagaatacaaaaagaaaatgtcatacatgatagcatttattaatgaatacttgaaaaagttatctagacctattcgtgatttagatgatgtcagatttgcaatggaagccttgtcttgcatacgtgataatgaaattcaaatggacatgactttgggaccaattgaagaagcctatgctattttaaacagatttgaagttgaagtaaccaaagaagaatcagaagcagttgataccttaagatattctttcaacaaattgcagagcaaagctgtttcagtacaagaggacctagttcaagtgcagccaaagtttaaaagcaatctacttgagtctgtggaagtttttcgtgaggacgtgataaactttgcagaagcatatgaattggaaggacctatggttccaaatataccaccccaagaagctagcaacaggctacagatatttcaggccagtttcgatgatctgtggaggaaatttgttacgtattcatctggtgaacaactttttggattgcctgtgactgattatgaggttttacacaaaaccagaaaagaactcaacttgctgcagaagctgtatggattgtatgacaccgtaatgagcagtattagtggttattatgaaatactttggggagatgtagatattgaaaaaattaatgcagaactgctggaatttcaaaacagatgtcgtaaacttccaaaaggacttaaagattggcaagcttttttggatctcaaaaagagaattgatgatttcagtgagtcatgtcctctactggaaatgatgaccaataaggccatgaaacagagacactgggatagaatctccgagttaactggaaccccatttgatgtggaatctgattctttttgccttagaaatatcatggaagcaccactccttaaacataaggatgatattgaggatatttgcatatctgccattaaggagaaggatatcgaagccaagctgactcaggtgattgagaattggaccaaccaaaatctgagttttgcagcatttaagggaaaaggagagctcctgctcaaaggaaccgaatcgggagaaattatcactttgatggaggatagtttaatggtcttagggtctttactcagcaacagatacaatgctccatttaaaaaaaatatccagaattgggtgtataaattgtccacttcctcagatataattgaagagtggctcgtagtacagaacctttgggtttatcttgaagccgtctttgtaggtggagatattgccaaacagctgcctcaggaagcaaaacgttttcagaatattgacaagtcttggataaaaataatgcagcgagctcatgagaatcccaatgtgattaattgctgtgttggagatgaaaccatgggacaacttttacctcatttacatgagcagttggaagtatgtcagaagtcactcacagggtatttggagaagaaacgattactgtttccaagattcttctttgtatctgatccagttctcctggaaattcttggacaagccagtgattcccacaccatacagccgcatctccctgcagtatctgacaacatcaatgaggtgacatttcatgcaaaagactatgatcgcatcatggccgtcatatcaagagaaggagaaaaaattgttttggataattctgttatggccaaaggtcctgtggagatttggctactggatttgttaaaaatgcagatgtcatcattacataatataattagatccgctttctatcaaatcagtgattcaggatttcaactcttaccattcctcagccactttccagcacaggttggacttctgggaattcagatgttgtggacacacgattcagaagaggctttacgtaatgcaaaagatgacaggaaaatcatgcaagtgaccaatcagaaatttttggatattctaaatactctcattagtcagacaacacatgatctaagcaagtttgatagagtgaagttcgagactctaattaccatccatgtgcatcagagagatatttttgatgacttggtaaaaatgcatatcaaatcacctactgactttgaatggctaaaacagagtagattttattttaaggaagatttggatcaaactgtggtgtctattacagatgttgattttatttaccaaaatgaatttctgggatgtactgatcgtcttgttatcactccattaacagatagatgctatatcacgttagctcaggccttgggcatgaacatgggaggtgctcccgcaggacctgctggcactggcaaaacagaaaccacaaaagacatgggaaggtgtttgggaaaatatgtggtcgtgttcaattgctcagatcaaatggatttcagaggcctaggaaggattttcaaaggtcttgcacagtcgggttcctggggctgttttgatgagtttaacagaattgaattgcctgtattatcagtggcagcacaacaaatttatattgttttgacagcaagaaaagaaagaaagaaacagttcattttttctgatggtgattgtgttgatttaaatccagaatttggaatcttcttaacgatgaaccctggatatgctgggcgccaggaactaccagaaaacctaaaaatccagtttagaactgttgctatgatggttcctgatagacagatcattatgagagttaaacttgcaagctgtggttttcttgaaaatgttatcttggctcaaaaattttacgttctttacaaactctgtgaagagcaacttactaaacaggttcattatgactttggattgagaaatattctgtctgtattgaggactcttggatctcaaaaaagagccagaccagaagatagtgaattaagcattgtcatgagaggactaagagatatgaacctttccaaactggttgatgaagatgaacccctgttcctcagcttaatcaatgacctgttcccaggactgcaactggatagtaatacttatgcagaactgcaaaacgcagtagcccatcaggttcagatagagggtttgattaaccatccaccctggaacctgaaactcgtgcagttatatgagacgtctttggtacggcatggcttgatgactcttgggcccagtggttctggaaagacaaccgttatcacgattctaatgaaggcgcaaacagaatgcggaaggcctcatagagaaatgcgaatgaatccaaaagccattactgcacctcagatgtttggcagactggacactgctaccaatgactggacagatgggattttttctactctgtggagaaaaacattaaaagctaaaaaaggtgaaaacattttcctcattttagatggtcctgtggatgccatctggattgagaacttaaattccgttttggatgacaataaaactctgacgttagctaatggagatcgcattcccatggcccctagttgtaagcttctgtttgaagtccacaatatcgagaacgcctctcctgccacggtttctaggatgggcatggtctatatcagcagctctgctctcagctggaggccaatcttacaggcatggttgaagaaacgcactgcacaggaagctgctgtattcctgacactgtatgagaaagtctttgaagatacatacacatatatgaagctaaatctcaatcccaaaatgcagctcttggagtgcaactatattgtgcaatctctcaatcttctggaagggttaattccctccaaagaagaaggcggtgtttcctgtgtcgaacatcttcataaattatttgtgtttggcctaatgtggagtttaggagcccttctggaattagaaagcagagaaaagcttgaagccttcttacggcagcatgaaagcaagttggacttaccagaaatacctaaaggctcaaatcaaaccatgtatgagttttatgttactgattatggtgattgggagcactggaataagaaacttcagccttattattatccaactgacagtattccggaatattcatcaattttggttccaaatgttgacaatattagaacaaattttttgatagacaccattgcaaaacaacataaagctgttttgctcacaggagagcagggaactgcaaaaactgtcatggttaaggcctatttgaaaaaatatgatcctgaagtacagctatccaaaagtctaaacttttcatctgccacagaaccaatgatgtttcagagaacaattgaaagctacgtggataagcgaattggaagcacatatgggccaccaggagggagaaaaatgactgtatttattgatgatattaatatgcctgtgattaatgagtggggagatcagataactaatgagattgtgcgacagatgatggaaatggaaggaatgtacagcttggacaagcctggagacttcactactattgttgatgtgcagctcatagcagcaatgatccaccctggaggtggtcgaaatgatattccacaacgtttaaaaagacaatttactgtgtttaattgtacattgccttcaaatgcttcaatagacaaaatttttggaattattggatgtggatactttgatccttgtagaagtttcaagcctcaaatatgtgagatgattgtgaatttagtctcagtgggtagagtgctgtggcaatggactaaggtgaagatgctgccaactccttctaaatttcattacatcttcaatcttcgagatctttccagaatttggcaaggaatgttgaccataaaagctgaggagtgcgcttcaatccctactctcctgtcccttttcaaacacgagtgcagcagagtaattgcagacagatttataactcctgaagatgagcagtggtttaatgcacatcttactcgtgcagttgaagaaaatattggctctgatgcagcgtcgtgtattcttcctgaaccatactttgtggattttcttcgtgagatgccagaaccaactggtgatgaacctgaagactctgtgtttgaagtacccaaaatatatgaattgatgccatcctttgactttctggctgaaaaactccagttttaccagagacagttcaatgaaatcattagaggaacatctcttgatctggtgttttttaaagatgcaatgactcatcttattaagatttcacgaataattcgaacgtcgtgtggaaatgcattgctggtgggtgttggtggttccggaaaacaaagtctttcaagattggcctcttttattgctggctatcaaatattccagataacattaaccaggtcttacaatgtgactaatctaacagatgatttaaaagctttgtacaaagttgctggtgctgatggaaaaggcatcactttcatctttactgacagtgaaataaaagatgaggcatttctagaataccttaacaacttgctatcttcaggggagatctccaacttgtttgcacgagatgagatggatgaaatcacccaaggtctgatttcagtgatgaagagggagctacctcgccatcctcctacctttgataatttgtatgaatacttcatttcaagatcaaggaagaacttacatgttgttctctgcttttctccagttggtgagaagttccgtgcccgttctttgaaatttcctggcttgatatcaggttgcactatggactggttcagccgctggccaagggaggctctgattgctgtggcctcctacttcctttcagactataatattgtctgctctagtgaaattaaaagacaagttgtagaaacaatgggcctgtttcatgacatggtttcagagagctgtgaaagttatttccaaagataccgccgaagagcacatgtgactcccaaatcttacctctcatttataaatggttataaaaacatttatgctgaaaaggtgaagttcattaatgaacaggctgaacgtatgaatattggtcttgataaactaatggaggcaagtgaatctgttgctaaactctctcaggatcttgcagtcaaggagaaggagttggcagtggcttccataaaagcagacgaagtattagcagaagtcacagtaagcgctcaggcttcagccaaaattaaaaatgaagtacaggaggtaaaggacaaagcccaaaaaattgtggatgaaattgatagtgaaaaagtgaaagctgaaagcaagcttgaggcagctaaacctgcactggaagaagcagaagcagccctgaatactatcaagccaaatgatattgccacagtcaggaaacttgcaaaaccaccacatcttattatgagaatcatggactgtgttctgttactatttcaaaagaaaattgaccctgttactatggatccagaaaaatcttgctgtaagccatcatggggagagtcattaaagttgatgagtgcaacaggattcctgtggagccttcagcagttccctaaggacactataaatgaagagactgttgagttactacagccatattttaatatggatgattatacttttgaaagtgccaaaaaagtctgtgggaatgtggctggtctcctgtcttggacacttgctatggcaatattttatggcatcaatagagaagtgttgcctctgaaggccaacctggccaagcaggaaggccggttagcagttgctaatgctgagttagggaaggcacaagccctgctggatgagaagcaagctgagctggataaagtacaggcaaaatttgatgcagcaatgaatgagaaaatggatttgcttaatgacgctgatacgtgccggaaaaagatgcaggccgcctccactctcatcgatgggctgagtggagaaaaaatccggtggacccagcaaagtaaagaattcaaagctcagattaatagacttgtaggtgatattctgctgtgcacgggattcctttcctaccttggtcctttcaatcagatatttaggaactatttgcttaaagatcaatgggaaatggagttgagagcacggaaaattcctttcacagaaaacctgaatcttatttcaatgttggtggatcctccaactattggtgagtgggggctacagggattaccaggagatgatctctcaattcagaatggcattattgtgacaaaggccaccagatacccactcctcatagacccacaaactcaaggcaaaacttggattaaatcaaaggaaaaagaaaatgatttacaggtgacatctctgaaccataaatattttcgcacacacttggaggacagcctttccttgggccgaccccttctcattgaggacattcatgaagagctggatccagccttggataatgtattagaaaagaattttattaaatctggcaccactttcaaggtgaaagtcggtgataaggaatgtgatatcatggatacatttaaactttacattactacgaagttaccaaatcctgcctttaccccagagattaatgctaaaacgtcagtcattgatttcactgttacaatgaaaggacttgagaatcagttactaaggagagtcattctaacagagaaacaggagttagaggctgagagggttaaacttttggaggatgttacttttaataagcggaagatgaaagaacttgaagataacctcctctataaattaagtgctacaaaaggctcattggtagatgacgaatctctcattggtgtacttcgaactaccaagcagacagcagctgaggtaagtgaaaagttgcatgtggctgcagaaactgagatcaagatcaacgcggctcaggaggagttccggcccgcagccacccgcggaagcatcctctacttcctcatcacagagatgagcatggtcaacatcatgtatcagacgtcattggcccagttcttgaagttatttgaccagtccatggccagatctgaaaagtcaccactacctcaaaagagaattacaaatattatcgagtacctgacatatgaagtttttacatactctgtcagaggcctatacgaaaaccacaaattcctgtttgtactcctcatgaccttaaagattgaccttcagagagggacagttaagcacagagagtttcaagctctcattaaagggggagcagctctggacctgaaagcctgtcctcccaaaccctatcgctggatccttgacatgacttggctgaatcttgtggagctgagtaaacttccacaatttgcagaaattatgaaccagatatctcgtaatgagaaggggtggaaaagctggtttgataaagatgctccagaggaggaaattatccctgatggatataatgattcactagatacctgccataaacttttacttatcaggtcttggtgcccagaccgtactgtttttcaagcaagaaagtatattgcagattctttggaggagaagtacacagaaccagttatcttaaatctggagaaaacttgggaagaaagtgatacccggacacctctgatatgcttcctgtccatgggatctgaccccaccaatcaaattgatgcattggccaagaaactgaaactggaatgtagaactatctcaatggggcaaggacaagaagtacatgctcgaaagctgattcagatgtcaatgcagcagggtggttgggtattactacaaaattgccaccttggcctggaattcatggaagaattactagagacgctaattaccactgaagccagtgatgattctttccgagtatggataactacggagccccatgatcgatttccaattacattgcttcagacctctctcaaattcactaatgagccaccccaaggtgtacgcgcaggtttgaaaagaacatttgctggaattaatcaagaccttctggacatcagtaatttacccatgtggaagccgatgctttacacagtagcatttttacactccactgtgcaggagcgacgaaaatttggccccttaggatggaatattccctacgaattcaattctgctgacttttcagccagtgttcagtttattcagaatcaccttgatgaatgcgatattaagaaaggtgtatcatggaatacggttcggtacatgatcggagaagtacaatatggaggcagagtgacagatgactttgacaaacgtctacttaattgctttgccagagtctggttcagtgagaagatgtttgaaccgtcattctgcttttatactggatataaaatccccttatgcaaaaccttagaccagtattttgaatacatccagtcactgccatccctagataaccctgaagtctttgggcttcaccctaatgctgatatcacgtatcagagtaacactgcttctgctgttcttgaaacaattaccaacattcaacccaaagagagtggaggtggtgtgggagagacccgggaggctattgtttatagattatctgaagatatgctgagtaaactccctcctgattacattcctcatgaggtgaaatctcgtttgataaagatgggccatcttaattcaatgaacatatttcttagacaagaaattgacagaatgcaaagagtcatttcaatactccgcagtagcctgagtgatctaaaattggccattgaaggaacaatcattatgagtgagaatctgagagatgctctggacaacatgtatgatgctcgtatacctcagctctggaaaagagtgtcttgggattcgtccacactgggcttctggttcactgaacttttggaaagaaatgctcagttttctacgtggatatttgaagggaggcctaatgtgttttggatgactggtttctttaatccccaaggcttcctcacagcaatgaggcaagaagtgacccgtgcccacaaaggctgggcactggacactgtgaccatccacaatgaagttctgagacagaccaaggaggagatcacgtcaccccctggggaaggtgtgtatatttatgggctctacatggatggagcagcctgggacagacggaatgggaagctcatggaatccacccccaaggtactcttcacgcagttacccgtgctccacatctttgccattaactccacggcacccaaggaccccaagctgtatgtgtgtcctatttacaagaaacccaggcgaactgatttgaccttcatcactgtggtatatttacgaacagtgttgtccccggatcactggatcctgagaggagtggcccttttgtgtgacatcaagtaagttcatttccatctgctcagggcaccagaacccacatagacagcctgtgctattgagggactcagtgatgtgtgtgtcttttctccccagtaattccttaattactctttctacattaaaaagttgatgttctaaaattgctagtgcgtgtgtgttttcctcacatatcaatattcaaaaagataactctaaatgaatgttttttattctgggaaatcatatttcactataattactttttaaagataaaaccctgtttggatgttagaacactttggaagctctgaattttaaaaatttgaaagtgttgatatgtgacatcctaaaaagagcctagtagttgtaaacttttccctcaagtaggtaccaatttcccttgaataaaatctagccatgtctatgtctg

SEQ ID NO: 128 - DNA, 14554 bp, Homo sapiens
cccggggcagcgcaaccgctggggccggcctcagtgggctgagtggtcggggcatcggggcccagagagcggctggtttcgaagtataaagcattccgcacgacgggggatggagaaggatgctgaagatggcgccccttctgagggagcagaggctcctccctctacggaagaggctgcccctccccgttcagaagaggaagaggccccgcgccctccgacagtggaggccccggcagaagatggtttctctccttccgcagaagatgctgtttcttctgtggtggattatcgggatctcattccttctgaagaagggatagttcttccagatgatcatgaagcggatctgaatagagttcgacagaggcttgcaccgcgaccggttcagtcagtgatttcggaagtgctgtccttgccgtcttcccggaggtcctccagataccgccggagtatgagtggccttcccaatctacaggaaacattaaaagagagacaggcaagatttagagaggcaagggaaagccgaagactgaaaattgacccttcatacaaatatatatttgaaattctagcagaaaatcttggcctggacatagtaactgttgaagaattaattttggattgcccatctaatgtggtcgaactattgctggagcaactaaaggggcaaaaatgatgaaattgtatatagacaatgcagccccggataaactaaaaggactgtgcatattttttgttcgttgccgtaatgatgttgctataaatgttaaaactattcaagaggaagcgctctttactgttctggatgcgtcgaaaggactcttaaatggaattagggatatgttggcaaatatatttctaccagctgttcttgcaacaaacaactggggtgctttaaaccagtccaagcagggagaatctgaaaaacatattttcactgaaaccatcaacagatatctttcatttttagatggtgctagaataagtattgagggaacagtgaagttaaagacaatagacaatgttaatttttccaaactgcacacctttgaagaagtaactgctgcagccagcaactcagaaactgttcatcagctggaggaagtgctgatggtatggtacaaacagatcgaacaggtacttattgagagtgagcagatgagaaaagaagctggtgattcaggtccactcactgaattggaacactggaaacgcatgtcagccaagttcaactatatcattgagcagattaaagggccaagttgtaaggctgtcataaatgtgctaaatgttgcacactccaaactgctaaagaattggcgtgatttggatgcaagaatcactgatacagcaaatgaatccaaagataatgtcagatatttgtatactttggaaaaagtgtgtcaacctctctataaccatgacctagtttccatggcacatggaatacaaaatttgattaatgccatcagaatgattcacggtgtgtcaaggtattataatacctcagagagaatgacctcattgtttatcaaggtaacaaatcaaatggtaacagcatgtaaagcatatattactgatggaggattaaaccatgtatgggatcaggaaacgccagttgtactaaagaaaattcaggactgcatttttctattcaaggaatatcaggcatcttttcataaaacaaggaaactgatttcagaatcctcaggggaaaaatcttttgaggtttcagaaatgtatatatttggaaaatttgaagctttttgcaaaagactggagaagattacagaaatgataactgttgtgcaaacatattcaaccttgagtaattctaccatagaaggaatagatattatggcaataaaattcagaaatatataccaaggggttaagaaaaagcaatatgacattctggatccaagaaggacagaatttgacacagatttcttagatttcatgacaaaaatcaatggtttagaggtacaaatacaggcatttatgaacagtagttttgggaaaatcttatcttctcagcaggctcttcagctacttcaaaggtttcagaagctgaacattccctgtctgggattagaaataaaccacacaatagagcgtattcttcagtactatgtggctgaacttgatgctactaagaagctttatcattctcagaaagatgacccccctcttgctcgcaacatgccccctatagcaggaaaaatactctgggtgaggcagctctatcgccggataagtgagcccatcaattatttctttaaaaactcagacattttatcaagtccggacggtaaagctgtcatccgtcagtataacaagatctcctatgtgctggtggaattcgaggtggtctatcacacagcctggatcagagagatttcacagttgcattacgctttacaagccacgctttttgtgcgacatccagaaacagggaagttgctggttaatttcgatcccaaaattttggaagttgttcgggaaactaagtgtatgataaaaatgaagttggatgtaccagaacaggcaaagagattgctaaaattggaaagtaaattgaaagcagacaaactgtatttgcagggtcttctgcaatattatgatgagttatgtcaggaagtgccttctgtgtttgtcaatctgatgaccccaaaaatgaaaaaggtggaatctgtgttgaggcaaggactcacagtgttaacatggtcgtctttaacactggaaagcttctttcaagaagtcgaattagttttggatatgttcaatcaacttttaaagaagatcagtgacttgtgtgaaatgcatattgatacagttctgaaggagatagccaaaactgtgttgatttctctgcctgaaagtggtgctaccaaagtagaagatatgttgaccctcaatgagacatacacaaaagaatgggctgacattctaaaccacaaaagtaagcatgtggaagaagctgtcagagaacttatatcaatatttgagcagatttatgaagtgaaatacactgggaaagtaggaaaacagtcagaacagcggaaacacgttgtttttggaagtgaaacaggagagggtgaaaacaatgactatgaagctaatattgtgaatgagtttgatactcatgataaagaagatgaatttaaaaaggagtgtaaagaggtctttgcttttttctctcatcaattactagacagtcttcaaaaagctacacggttatctctggacacaatgaaaagaagaatatttgttgcaagcctttatgggcgaaagcagtcagaagatattatttcctttataaaaagtgaagtacatcttgcaattcctaatgtggtgatgattcctagtttggatgacattcaacaagccattaaccgtatgatccagttaaccctggaggtcagcagaggagtggctcactgggggcaacagcaaatccgtcccatcaagtctgtcattcccagccccaccactactgacgtgacccatcaaaacacaggaaaactgctgaagaaggaagaaagatcttttgaagaagctattcctgcgaggaagctgaagaatttttacccgggggtagcggagcacaaggatatttctaagttggtcctgctcctttcttcctctgtaaattccctaagaaaggcagctcatgaggccctgcaggactttcagaagtacaagactctctggacagaggaccgcgatgtgaaagtgaaggaatttttggctaacaacccctctctgactgaaatcagatcagaaattctacactatgctacttttgaacaggagattgatgagttgaagcctattattgttgtaggagcacttgaattacatacagagccgatgaaattggccttatccatcgaggccaaggcatggaagatgttactctgtcgatatctgaatgaagaatacaaaaagaaaatgtcatacatgatagcatttattaatgaatacttgaaaaagttatctagacctattcgtgatttagatgatgtcagatttgcaatggaagccttgtcttgcatacgtgataatgaaattcaaatggacatgactttgggaccaattgaagaagcctatgctattttaaacagatttgaagttgaagtaaccaaagaagaatcagaagcagttgataccttaagatattctttcaacaaattgcagagcaaagctgtttcagtacaagaggacctagttcaagtgcagccaaagtttaaaagcaatctacttgagtctgtggaagtttttcgtgaggacgtgataaactttgcagaagcatatgaattggaaggacctatggttccaaatataccaccccaagaagctagcaacaggctacagatatttcaggccagtttcgatgatctgtggaggaaatttgttacgtattcatctggtgaacaactttttggattgcctgtgactgattatgaggttttacacaaaaccagaaaagaactcaacttgctgcagaagctgtatggattgtatgacaccgtaatgagcagtattagtggttattatgaaatactttggggagatgtagatattgaaaaaattaatgcagaactgctggaatttcaaaacagatgtcgtaaacttccaaaaggacttaaagattggcaagcttttttggatctcaaaaagagaattgatgatttcagtgagtcatgtcctctactggaaatgatgaccaataaggccatgaaacagagacactgggatagaatctccgagttaactggaaccccatttgatgtggaatctgattctttttgccttagaaatatcatggaagcaccactccttaaacataaggatgatattgaggatatttgcatatctgccattaaggagaaggatatcgaagccaagctgactcaggtgattgagaattggaccaaccaaaatctgagttttgcagcatttaagggaaaaggagagctcctgctcaaaggaaccgaatcgggagaaattatcactttgatggaggatagtttaatggtcttagggtctttactcagcaacagatacaatgctccatttaaaaaaaatatccagaattgggtgtataaattgtccacttcctcagatataattgaagagtggctcgtagtacagaacctttgggtttatcttgaagccgtctttgtaggtggagatattgccaaacagctgcctcaggaagcaaaacgttttcagaatattgacaagtcttggataaaaataatgcagcgagctcatgagaatcccaatgtgattaattgctgtgttggagatgaaaccatgggacaacttttacctcatttacatgagcagttggaagtatgtcagaagtcactcacagggtatttggagaagaaacgattactgtttccaagattcttctttgtatctgatccagttctcctggaaattcttggacaagccagtgattcccacaccatacagccgcatctccctgcagtatctgacaacatcaatgaggtgacatttcatgcaaaagactatgatcgcatcatggccgtcatatcaagagaaggagaaaaaattgttttggataattctgttatggccaaaggtcctgtggagatttggctactggatttgttaaaaatgcagatgtcatcattacataatataattagatccgctttctatcaaatcagtgattcaggatttcaactcttaccattcctcagccactttccagcacaggttggacttctgggaattcagatgttgtggacacacgattcagaagaggctttacgtaatgcaaaagatgacaggaaaatcatgcaagtgaccaatcagaaatttttggatattctaaatactctcattagtcagacaacacatgatctaagcaagtttgatagagtgaagttcgagactctaattaccatccatgtgcatcagagagatatttttgatgacttggtaaaaatgcatatcaaatcacctactgactttgaatggctaaaacagagtagattttattttaaggaagatttggatcaaactgtggtgtctattacagatgttgattttatttaccaaaatgaatttctgggatgtactgatcgtcttgttatcactccattaacagatagatgctatatcacgttagctcaggccttgggcatgaacatgggaggtgctcccgcaggacctgctggcactggcaaaacagaaaccacaaaagacatgggaaggtgtttgggaaaatatgtggtcgtgttcaattgctcagatcaaatggatttcagaggcctaggaaggattttcaaaggtcttgcacagtcgggttcctggggctgttttgatgagtttaacagaattgaattgcctgtattatcagtggcagcacaacaaatttatattgttttgacagcaagaaaagaaagaaagaaacagttcattttttctgatggtgattgtgttgatttaaatccagaatttggaatcttcttaacgatgaaccctggatatgctgggcgccaggaactaccagaaaacctaaaaatccagtttagaactgttgctatgatggttcctgatagacagatcattatgagagttaaacttgcaagctgtggttttcttgaaaatgttatcttggctcaaaaattttacgttctttacaaactctgtgaagagcaacttactaaacaggttcattatgactttggattgagaaatattctgtctgtattgaggactcttggatctcaaaaaagagccagaccagaagatagtgaattaagcattgtcatgagaggactaagagatatgaacctttccaaactggttgatgaagatgaacccctgttcctcagcttaatcaatgacctgttcccaggactgcaactggatagtaatacttatgcagaactgcaaaacgcagtagcccatcaggttcagatagagggtttgattaaccatccaccctggaacctgaaactcgtgcagttatatgagacgtctttggtacggcatggcttgatgactcttgggcccagtggttctggaaagacaaccgttatcacgattctaatgaaggcgcaaacagaatgcggaaggcctcatagagaaatgcgaatgaatccaaaagccattactgcacctcagatgtttggcagactggacactgctaccaatgactggacagatgggattttttctactctgtggagaaaaacattaaaagctaaaaaaggtgaaaacattttcctcattttagatggtcctgtggatgccatctggattgagaacttaaattccgttttggatgacaataaaactctgacgttagctaatggagatcgcattcccatggcccctagttgtaagcttctgtttgaagtccacaatatcgagaacgcctctcctgccacggtttctaggatgggcatggtctatatcagcagctctgctctcagctggaggccaatcttacaggcatggttgaagaaacgcactgcacaggaagctgctgtattcctgacactgtatgagaaagtctttgaagatacatacacatatatgaagctaaatctcaatcccaaaatgcagctcttggagtgcaactatattgtgcaatctctcaatcttctggaagggttaattccctccaaagaagaaggcggtgtttcctgtgtcgaacatcttcataaattatttgtgtttggcctaatgtggagtttaggagcccttctggaattagaaagcagagaaaagcttgaagccttcttacggcagcatgaaagcaagttggacttaccagaaatacctaaaggctcaaatcaaaccatgtatgagttttatgttactgattatggtgattgggagcactggaataagaaacttcagccttattattatccaactgacagtattccggaatattcatcaattttggttccaaatgttgacaatattagaacaaattttttgatagacaccattgcaaaacaacataaagctgttttgctcacaggagagcagggaactgcaaaaactgtcatggttaaggcctatttgaaaaaatatgatcctgaagtacagctatccaaaagtctaaacttttcatctgccacagaaccaatgatgtttcagagaacaattgaaagctacgtggataagcgaattggaagcacatatgggccaccaggagggagaaaaatgactgtatttattgatgatattaatatgcctgtgattaatgagtggggagatcagataactaatgagattgtgcgacagatgatggaaatggaaggaatgtacagcttggacaagcctggagacttcactactattgttgatgtgcagctcatagcagcaatgatccaccctggaggtggtcgaaatgatattccacaacgtttaaaaagacaatttactgtgtttaattgtacattgccttcaaatgcttcaatagacaaaatttttggaattattggatgtggatactttgatccttgtagaagtttcaagcctcaaatatgtgagatgattgtgaatttagtctcagtgggtagagtgctgtggcaatggactaaggtgaagatgctgccaactccttctaaatttcattacatcttcaatcttcgagatctttccagaatttggcaaggaatgttgaccataaaagctgaggagtgcgcttcaatccctactctcctgtcccttttcaaacacgagtgcagcagagtaattgcagacagatttataactcctgaagatgagcagtggtttaatgcacatcttactcgtgcagttgaagaaaatattggctctgatgcagcgtcgtgtattcttcctgaaccatactttgtggattttcttcgtgagatgccagaaccaactggtgatgaacctgaagactctgtgtttgaagtacccaaaatatatgaattgatgccatcctttgactttctggctgaaaaactccagttttaccagagacagttcaatgaaatcattagaggaacatctcttgatctggtgttttttaaagatgcaatgactcatcttattaagatttcacgaataattcgaacgtcgtgtggaaatgcattgctggtgggtgttggtggttccggaaaacaaagtctttcaagattggcctcttttattgctggctatcaaatattccagataacattaaccaggtcttacaatgtgactaatctaacagatgatttaaaagctttgtacaaagttgctggtgctgatggaaaaggcatcactttcatctttactgacagtgaaataaaagatgaggcatttctagaataccttaacaacttgctatcttcaggggagatctccaacttgtttgcacgagatgagatggatgaaatcacccaaggtctgatttcagtgatgaagagggagctacctcgccatcctcctacctttgataatttgtatgaatacttcatttcaagatcaaggaagaacttacatgttgttctctgcttttctccagttggtgagaagttccgtgcccgttctttgaaatttcctggcttgatatcaggttgcactatggactggttcagccgctggccaagggaggctctgattgctgtggcctcctacttcctttcagactataatattgtctgctctagtgaaattaaaagacaagttgtagaaacaatgggcctgtttcatgacatggtttcagagagctgtgaaagttatttccaaagataccgccgaagagcacatgtgactcccaaatcttacctctcatttataaatggttataaaaacatttatgctgaaaaggtgaagttcattaatgaacaggctgaacgtatgaatattggtcttgataaactaatggaggcaagtgaatctgttgctaaactctctcaggatcttgcagtcaaggagaaggagttggcagtggcttccataaaagcagacgaagtattagcagaagtcacagtaagcgctcaggcttcagccaaaattaaaaatgaagtacaggaggtaaaggacaaagcccaaaaaattgtggatgaaattgatagtgaaaaagtgaaagctgaaagcaagcttgaggcagctaaacctgcactggaagaagcagaagcagccctgaatactatcaagccaaatgatattgccacagtcaggaaacttgcaaaaccaccacatcttattatgagaatcatggactgtgttctgttactatttcaaaagaaaattgaccctgttactatggatccagaaaaatcttgctgtaagccatcatggggagagtcattaaagttgatgagtgcaacaggattcctgtggagccttcagcagttccctaaggacactataaatgaagagactgttgagttactacagccatattttaatatggatgattatacttttgaaagtgccaaaaaagtctgtgggaatgtggctggtctcctgtcttggacacttgctatggcaatattttatggcatcaatagagaagtgttgcctctgaaggccaacctggccaagcaggaaggccggttagcagttgctaatgctgagttagggaaggcacaagccctgctggatgagaagcaagctgagctggataaagtacaggcaaaatttgatgcagcaatgaatgagaaaatggatttgcttaatgacgctgatacgtgccggaaaaagatgcaggccgcctccactctcatcgatgggctgagtggagaaaaaatccggtggacccagcaaagtaaagaattcaaagctcagattaatagacttgtaggtgatattctgctgtgcacgggattcctttcctaccttggtcctttcaatcagatatttaggaactatttgcttaaagatcaatgggaaatggagttgagagcacggaaaattcctttcacagaaaacctgaatcttatttcaatgttggtggatcctccaactattggtgagtgggggctacagggattaccaggagatgatctctcaattcagaatggcattattgtgacaaaggccaccagatacccactcctcatagacccacaaactcaaggcaaaacttggattaaatcaaaggaaaaagaaaatgatttacaggtgacatctctgaaccataaatattttcgcacacacttggaggacagcctttccttgggccgaccccttctcattgaggacattcatgaagagctggatccagccttggataatgtattagaaaagaattttattaaatctggcaccactttcaaggtgaaagtcggtgataaggaatgtgatatcatggatacatttaaactttacattactacgaagttaccaaatcctgcctttaccccagagattaatgctaaaacgtcagtcattgatttcactgttacaatgaaaggacttgagaatcagttactaaggagagtcattctaacagagaaacaggagttagaggctgagagggttaaacttttggaggatgttacttttaataagcggaagatgaaagaacttgaagataacctcctctataaattaagtgctacaaaaggctcattggtagatgacgaatctctcattggtgtacttcgaactaccaagcagacagcagctgaggtaagtgaaaagttgcatgtggctgcagaaactgagatcaagatcaacgcggctcaggaggagttccggcccgcagccacccgcggaagcatcctctacttcctcatcacagagatgagcatggtcaacatcatgtatcagacgtcattggcccagttcttgaagttatttgaccagtccatggccagatctgaaaagtcaccactacctcaaaagagaattacaaatattatcgagtacctgacatatgaagtttttacatactctgtcagaggcctatacgaaaaccacaaattcctgtttgtactcctcatgaccttaaagattgaccttcagagagggacagttaagcacagagagtttcaagctctcattaaagggggagcagctctggacctgaaagcctgtcctcccaaaccctatcgctggatccttgacatgacttggctgaatcttgtggagctgagtaaacttccacaatttgcagaaattatgaaccagatatctcgtaatgagaaggggtggaaaagctggtttgataaagatgctccagaggaggaaattatccctgatggatataatgattcactagatacctgccataaacttttacttatcaggtcttggtgcccagaccgtactgtttttcaagcaagaaagtatattgcagattctttggaggagaagtacacagaaccagttatcttaaatctggagaaaacttgggaagaaagtgatacccggacacctctgatatgcttcctgtccatgggatctgaccccaccaatcaaattgatgcattggccaagaaactgaaactggaatgtagaactatctcaatggggcaaggacaagaagtacatgctcgaaagctgattcagatgtcaatgcagcagggtggttgggtattactacaaaattgccaccttggcctggaattcatggaagaattactagagacgctaattaccactgaagccagtgatgattctttccgagtatggataactacggagccccatgatcgatttccaattacattgcttcagacctctctcaaattcactaatgagccaccccaaggtgtacgcgcaggtttgaaaagaacatttgctggaattaatcaagaccttctggacatcagtaatttacccatgtggaagccgatgctttacacagtagcatttttacactccactgtgcaggagcgacgaaaatttggccccttaggatggaatattccctacgaattcaattctgctgacttttcagccagtgttcagtttattcagaatcaccttgatgaatgcgatattaagaaaggtgtatcatggaatacggttcggtacatgatcggagaagtacaatatggaggcagagtgacagatgactttgacaaacgtctacttaattgctttgccagagtctggttcagtgagaagatgtttgaaccgtcattctgcttttatactggatataaaatccccttatgcaaaaccttagaccagtattttgaatacatccagtcactgccatccctagataaccctgaagtctttgggcttcaccctaatgctgatatcacgtatcagagtaacactgcttctgctgttcttgaaacaattaccaacattcaacccaaagagagtggaggtggtgtgggagagacccgggaggctattgtttatagattatctgaagatatgctgagtaaactccctcctgattacattcctcatgaggtgaaatctcgtttgataaagatgggccatcttaattcaatgaacatatttcttagacaagaaattgacagaatgcaaagagtcatttcaatactccgcagtagcctgagtgatctaaaattggccattgaaggaacaatcattatgagtgagaatctgagagatgctctggacaacatgtatgatgctcgtatacctcagctctggaaaagagtgtcttgggattcgtccacactgggcttctggttcactgaacttttggaaagaaatgctcagttttctacgtggatatttgaagggaggcctaatgtgttttggatgactggtttctttaatccccaaggcttcctcacagcaatgaggcaagaagtgacccgtgcccacaaaggctgggcactggacactgtgaccatccacaatgaagttctgagacagaccaaggaggagatcacgtcaccccctggggaaggtgtgtatatttatgggctctacatggatggagcagcctgggacagacggaatgggaagctcatggaatccacccccaaggtactcttcacgcagttacccgtgctccacatctttgccattaactccacggcacccaaggaccccaagctgtatgtgtgtcctatttacaagaaacccaggcgaactgatttgaccttcatcactgtggtatatttacgaacagtgttgtccccggatcactggatcctgagaggagtggcccttttgtgtgacatcaagtaagttcatttccatctgctcagggcaccagaacccacatagacagcctgtgctattgagggactcagtgatgtgtgtgtcttttctccccagtaattccttaattactctttctacattaaaaagttgatgttctaaaattgctagtgcgtgtgtgttttcctcacatatcaatattcaaaaagataactctaaatgaatgttttttattctgggaaatcatatttcactataattactttttaaagataaaaccctgtttggatgttagaacactttggaagctctgaattttaaaaatttgaaagtgttgatatgtgacatcctaaaaagagcctagtagttgtaaacttttccctcaagtaggtaccaatttcccttgaataaaatctagccatgtctatgtctg

SEQ ID NO: 129 - DNA, 1219 bp, Homo sapiens
tgataatctaaggaaattcaccgaaaacctccagtagccacctgctctttgccctgacagttctcaaggaagtggtcctcctgctgccccaagcctgtcagcctccatgaaaccaagccttccacactataatacagaaaagtaaagtctttgctttccgggctaccttgtagcaatttgaggctctgtcatcagtttctgctacgtttcaaagatccaggagaagcttagtgttgtgtcaagacgccgatggacccatcacagtttaatccaacctacatcccagggtctccacaaatgctcaccgaagaaaattcccgggacgattcaggggcctctcaaatctcctccgagacgttgataaagaaccttagtaacttgactatcaacgctagtagcgaatctgtttcccctctattggaagctttactccgtcgagagtctgtgggggcagcagtcctcagggaaatcgaagatgagtggctttacagcaggagaggagtaagaacactgctgtctgtgcagagagaaaagatggcaagattgagatacatgttactgggcggagttcgtacgcatgaaagaagaccaacaaacaaggagcctaagggagttaagaaggaatcaagaccattcaaatgtccctgcagtttctgcgtgtctaatggatgggatccttctgagaatgctagaatagagaatcaagacaccaagccacttcagccataaatcttattcttgcacctttttttcttgctagtaattttatatagcaggttgagaaagctactctatgctagtatagactatacaccaataattttgataatgagttctaggatgtatttttcttgtatctttttcttcctactttgatactagtaattcataagggatctgtgtaatctgaatgtatttgaataactttagctctactgtttgatttgacccaaagaagccaagacgatataagtattcccatgtgtcttagaagcccaaagtcagtgagatgaaacccaacatcaagaaattgaagcaaagttacttgtggataaagaaagcattaggtagtttggctatagcataattagattttctggctttcaaaaatttggattgcaatcacagcaaactttgttatttttacagttttcagtacaaaagtgtttatatagaaacaataaagttgacatttgagtacctttaaaaaaaaaaaaaa

SEQ ID NO: 130 - DNA, 722 bp, Homo sapiens
ctgccatggaccccgcgcccggcgtcctagatccccgcgccgcgccgcccgcgctcctgggcaccccgcaagccgaggtgctggaggacgtgttgcgggagcagttcgggccgctgccccagctggccgctgtctgccggctcaagcggctgccctcgggcggctactcgtccactgaaaacctccagttggtgctggagcggcggcgtgtggccaacgccaaggagcgtgagcggataaaaaatctcaaccgtggttttgccagattgaaggcacttgtgccatttcttccccaaagcaggaagcccagcaaagttgatatccttaaaggtgcgactgaatatatacaggttctcagtgatcttttggaaggagccaaagactcaaagaaacaagacccagatgagcagagctatagtaacaacagttctgaatcacatacatcctcggcaagacagctgtcaagaaacatcacccaacatatcagctgtgctttcggcttgaagaatgaagaggaagggccttgggcagatggtggcagtggtgagccagcacacgcttgtcgccacagtgtgatgtctacgactgaaattatctccccaaccagaagtctggatagattcccagaagtagaactgctgagtcacagacttccacaagtatgaaaaatgaaaaggcccagggttaccttctagagacaaataaatgcagtcttgaaagtt

SEQ ID NO: 131 - DNA, 759 bp, Mus musculus
gcttggaacacctgaggcgcccaggtgcctctgctgcccgtggtcttgaccaccatggatacagcacctgcatccccagagcccttcctggtcactccgcaggctgaggtgctggaggagctgattcaggcccagatggggcccctgccccggctcgccgccatctgtaggctcaagcgcctgccctcaggcggctactccaccacggatgacctgcatctggtgttggagcgcaggcgtgtggccaacgccaaagagcgtgaacggataaaaaatctcaaccgtggctttgccaagctgaaggctctggtgccgtttctaccacagagcaggaagcccagtaaagttgatatccttaaaggtgccacagaatacatacagatactcggctgtgttctggaagaagcgaaggtctcagagaaacaaagccctgaggagcagacccacagtggcagaccctctgaccctcatgtgtcctcgactagagagctcttgggaaatgctacccaacctaccagctgtgcgagtggcttgaagaaagaagaggaggggccttgggcgtatgctggccatagtgagccattgtacagctaccatcagagcacagtacccgagactaggagttacttcactcattaggagtctgatgaaagagtccttctaaaatagtcatgtataagttgaaaagttcaaaaagcattgccaagatgagtatttttcatgtaaaatataattaaaatgagatgatatgggaaagga

SEQ ID NO: 132 - DNA, 1128 bp, Mus musculus
atgatggccagctaccccgagcccgaagacacggcggggaccctgctggctccggagagcggacgcgcagtcaaagaggccgaggcgtcgccgccgagtcccggcaagggaggcgggacaacaccggagaaaccagaccccgcgcagaagcccccgtactcgtacgtggcgctcatcgccatggcgatccgcgagagcgccgagaagaggctcactctgtccggcatctaccagtacatcatagccaagttcccgttctacgagaagaacaagaagggctggcagaatagcatccgccacaacctcagcctcaacgagtgcttcatcaaggtgccgcgcgagggcggcggcgagcgcaagggcaactactggacgctcgacccggcctgcgaggacatgttcgagaagggcaactaccggcgccgccgccgcatgaagcggcccttccggccgccgcccgctcacttccagcccggcaaggggctcttcgggagcggaggagcggcgggtggctgcggcgtgcccggagctggggccgatggctatggctacctggcgccacccaagtacctgcaatcggggttcctcaacaactcctggcccctgccgcagcctccctcgcccatgccctacgcctcctgccagatggcggcggctgcggcggccgctgctgcagccgctgcagccgccggcccgggcagccccggtgcagccgcggtggtcaaggggctggcgggccccgccgcctcctacgggccgtactcgcgcgtgcagagcatggcgctgcctccgggcgtcgtgaactcctacaacggcctggggggccctcctgccgcaccaccgccgccgccaccgccgccgcaccctcacccgcaccctcacgcacatcatctgcacgcggccgctgcgcccccgccagccccgccacaccacggggctgccgcgcctcccccgggtcagctcagtcccgccagcccggccaccgccgcgcccccggcacccgcgcccacgagcgcgcccggcctgcagttcgcctgcgcccggcaacccgagctcgccatgatgcattgctcatactgggaccacgacagcaagacgggcgcgctgcactcgcgtctggatctctga

SEQ ID NO: 133 - DNA, 5779 bp, Homo sapiens
gatcccgtaagtcgggcggcctggtagtcgcagcagccgctgccgcagccgccacattcaacaggcagcagcgcagcgggcgcgccgctggggagagcaagcggcccgcggcgtccgtccgtccttccgtccgcggccctgtcagctggagcgcggcgcaggctctgccccggcccggcggctctggccggccgtccagtccgtgcggcggaccccgaggagcctcgatgtggatggccccgcgaagttaagttctgggctcgcgcttccactccgccgcgccttcctcccagtttccgtccgctcgccgcaccggcttcgttcccccaaatctcggaccgtcccttcgcgccccctccccgtccgcccccagtgctgcgttctccccctcttggctctcctgcggctgggggaggggcgggggtcaccatggccgaggcgcctcaggtggtggagatcgacccggacttcgagccgctgccccggccgcgctcgtgcacctggccgctgcccaggccggagtttagccagtccaactcggccacctccagcccggcgccgtcgggcagcgcggctgccaaccccgacgccgcggcgggcctgccctcggcctcggctgccgctgtcagcgccgacttcatgagcaacctgagcttgctggaggagagcgaggacttcccgcaggcgcccggctccgtggcggcggcggtggcggcggcggccgccgcggccgccaccggggggctgtgcggggacttccagggcccggaggcgggctgcctgcacccagcgccaccgcagcccccgccgcccgggccgctgtcgcagcacccgccggtgccccccgccgccgctgggccgctcgcggggcagccgcgcaagagcagctcgtcccgccgcaacgcgtggggcaacctgtcctacgccgacctcatcaccaaggccatcgagagctcggcggagaagcggctcacgctgtcgcagatctacgagtggatggtcaagagcgtgccctacttcaaggataagggtgacagcaacagctcggcgggctggaagaattcaattcgtcataatctgtccctacacagcaagttcattcgtgtgcagaatgaaggaactggaaaaagttcttggtggatgctcaatccagagggtggcaagagcgggaaatctcctaggagaagagctgcatccatggacaacaacagtaaatttgctaagagccgaagccgagctgccaagaagaaagcatctctccagtctggccaggagggtgctggggacagccctggatcacagttttccaaatggcctgcaagccctggctctcacagcaatgatgactttgataactggagtacatttcgccctcgaactagctcaaatgctagtactattagtgggagactctcacccattatgaccgaacaggatgatcttggagaaggggatgtgcattctatggtgtacccgccatctgccgcaaagatggcctctactttacccagtctgtctgagataagcaatcccgaaaacatggaaaatcttttggataatctcaaccttctctcatcaccaacatcattaactgtttcgacccagtcctcacctggcaccatgatgcagcagacgccgtgctactcgtttgcgccaccaaacaccagtttgaattcacccagcccaaactaccaaaaatatacatatggccaatccagcatgagccctttgccccagatgcctatacaaacacttcaggacaataagtcgagttatggaggtatgagtcagtataactgtgcgcctggactcttgaaggagttgctgacttctgactctcctccccataatgacattatgacaccagttgatcctggggtagcccagcccaacagccgggttctgggccagaacgtcatgatgggccctaattcggtcatgtcaacctatggcagccaggcatctcataacaaaatgatgaatcccagctcccatacccaccctggacatgctcagcagacatctgcagttaacgggcgtcccctgccccacacggtaagcaccatgccccacacctcgggtatgaaccgcctgacccaagtgaagacacctgtacaagtgcctctgccccaccccatgcagatgagtgccctggggggctactcctccgtgagcagctgcaatggctatggcagaatgggccttctccaccaggagaagctcccaagtgacttggatggcatgttcattgagcgcttagactgtgacatggaatccatcattcggaatgacctcatggatggagatacattggattttaactttgacaatgtgttgcccaaccaaagcttcccacacagtgtcaagacaacgacacatagctgggtgtcaggctgagggttagtgagcaggttacacttaaaagtacttcagattgtctgacagcaggaactgagagaagcagtccaaagatgtctttcaccaactcccttttagttttcttggttaaaaaaaaaaacaaaaaaaaaaaccctccttttttcctttcgtcagacttggcagcaaagacatttttcctgtacaggatgtttgcccaatgtgtgcaggttatgtgctgctgtagataaggactgtgccattggaaatttcattacaatgaagtgccaaactcactacaccatataattgcagaaaagattttcagatcctggtgtgctttcaagttttgtatataagcagtagatacagattgtatttgtgtgtgtttttggtttttctaaatatccaattggtccaaggaaagtttatactctttttgtaatactgtgatgggcctcatgtcttgataagttaaacttttgtttgtactacctgttttctgcggaactgacggatcacaaagaactgaatctccattctgcatctccattgaacagccttggacctgttcacgttgccacagaattcacatgagaaccaagtagcctgttatcaatctgctaaattaatggacttgttaaacttttggaaaaaaaaagattaaatgccagctttgtacaggtcttttctatttttttttgtttattttgttatttgcaaatttgtacaaacatttaaatggttctaatttccagataaatgatttttgatgttattgttgggacttaagaacatttttggaatagatattgaactgtaataatgttttcttaaaactagagtctactttgttacatagtcagcttgtaaattttgtggaaccacaggtatttggggcagcattcataattttcattttgtattctaactggattagtactaattttatacatgcttaactggtttgtacactttgggatgctacttagtgatgtttctgactaatcttaaatcattgtaattagtacttgcatattcaacgtttcaggccctggttgggcaggaaagtgatgtatagttatggacactttgcgtttcttatttaggataacttaatatgtttttatgtatgtattttaaagaaatttcatctgcttctactgaactatgcgtactgcatagcatcaagtcttctctagagacctctgtagtcctgggaggcctcataatgtttgtagatcagaaaagggagatctgcatctaaagcaatggtcctttgtcaaacgagggattttgatccacttcaccattttgagttgagctttagcaaaagtttcccctcataattctttgctcttgtttcagtccaggtggaggttggttttgtagttctgccttgaggaattatgtcaacactcatacttcatctcattctcccttctgccctgcagattagattacttagcacactgtggaagtttaagtggaaggagggaatttaaaaatgggacttgagtggtttgtagaatttgtgttcataagttcagatgggtagcaaatggaatagaacttacttaaaaattggggagatttatttgaaaaccagctgtaagttgtgcattgagattatgttaaaagccttggcttaagaatttgaaaatttctttagcctgtagcaacctaaactgtaattcctatcattatgttttattactttccaattacctgtaactgacagaccaaattaattggctttgtgtcctatttagtccatcagtattttcaagtcatgtggaaagcccaaagtcatcacaatgaagagaacaggtgcacagcactgttcctcttgtgttcttgagaaggatctaatttttctgtatatagcccacatcacacttgctttgtcttgtatgttaattgcatcttcattggcttggtatttcctaaatgtttaacaagaacacaagtgttcctgataagatttcctacagtaagccagctctattgtaagcttcccactgtgatgatcatttttttgaagattcattgaacagccaccactctatcatcctcattttggggcagtccaagacatagctggttttagaaacccaagttcctctaagcacagcctcccgggtatgtaactgaacttggtgccaaagtacttgtgtactaatttctattactacgtactgtcactttcctcccgtgccattactgcatcataatacaaggaacctcagagcccccatttgttcattaaagaggcaactacagccaaaatcactgttaaaatcttactacttcatggagtagctcttaggaaaatatatcttcctcctgagtctgggtaattatacctctcccaagcccccattgtgtgttgaaatcctgtcatgaatccttggtagctctctgagaacagtgaagtccagggaaaggcatctggtctgtctggaaagcaaacattatgtggcctctggtagtttttttcctgtaagaatactgactttctggagtaatgagtatatatcagttattgtacatgattgctttgtgaaatgtgcaaatgatatcacctatgcagccttgtttgatttattttctctggtttgtactgttattaaaagcatattgtattatagagctattcagatattttaaatataaagatgtattgtttccgtaatatagacgtatggaatatatttaggtaatagatgtattacttggaaagttctgctttgacaaactgacaaagtctaaatgagcacatgtatcccagtgagcagtaaatcaatggaacatcccaagaagaggataaggatgcttaaaatggaaatcattctccaacgatatacaaattggacttgttcaactgctggatatatgctaccaataaccccagccccaacttaaaattcttacattcaagctcctaagagttcttaatttataactaattttaaaagagaagtttcttttctggttttagtttgggaataatcattcattaaaaaaaatgtattgtggtttatgcgaacagaccaacctggcattacagttggcctctccttgaggtgggcacagcctggcagtgtggccaggggtggccatgtaagtcccatcaggacgtagtcatgcctcctgcatttcgctacccgagtttagtaacagtgcagattccacgttcttgttccgatactctgagaagtgcctgatgttgatgtacttacagacacaagaacaatctttgctataattgtataaagccataaatgtacataaattatgtttaaatggcttggtgtctttcttttctaattatgcagaataagctctttattaggaattttttgtgaagctattaaatacttgagttaagtcttgtcagcca

SEQ ID NO: 134 - DNA, 3340 bp, Homo sapiens
gcgcgaggccgtcgattcgctcgcggctccatcgcggcctggccggggggcggtgtctgctgcgccaggttcgctggccgcacgtcttcaggtcctcctgttcctgggaggcgggcgcggcaggactgggaggtggcggcagcgggcgaggactcgccgaggacggggctccggcccgggataaccaactctccttctctcttctttggtgcttccccaggcggcggcggcggcgcccgggagccggagccttcgcggcgtccacgtccctcccccgctgcaccccgccccggcgcgagaggagagcgcgagagccccagccgcgggcgggcgggcggcgaagatggcagaggcaccggcttccccggccccgctctctccgctcgaagtggagctggacccggagttcgagccccagagccgtccgcgatcctgtacgtggcccctgcaaaggccggagctccaagcgagccctgccaagccctcgggggagacggccgctgactccatgatccccgaggaggaggacgatgaagacgacgaggacggcgggggacgggccggctcggccatggcgatcggcggcggcggcgggagcggcacgctgggctccgggctgctccttgaggactcggcccgggtgctggcacccggagggcaagaccccgggtctgggccagccaccgcggcgggcgggctgagcgggggtacacaggcgctgctgcagcctcagcaaccgctgccaccgccgcagccgggggcggctgggggctccgggcagccgaggaaatgttcgtcgcggcggaacgcctggggaaacctgtcctacgcggacctgatcacccgcgccatcgagagctccccggacaaacggctcactctgtcccagatctacgagtggatggtgcgttgcgtgccctacttcaaggataagggcgacagcaacagctctgccggctggaagaactccatccggcacaacctgtcactgcatagtcgattcatgcgggtccagaatgagggaactggcaagagctcttggtggatcatcaaccctgatggggggaagagcggaaaagccccccggcggcgggctgtctccatggacaatagcaacaagtataccaagagccgtggccgcgcagccaagaagaaggcagccctgcagacagcccccgaatcagctgacgacagtccctcccagctctccaagtggcctggcagccccacgtcacgcagcagtgatgagctggatgcgtggacggacttccgttcacgcaccaattctaacgccagcacagtcagtggccgcctgtcgcccatcatggcaagcacagagttggatgaagtccaggacgatgatgcgcctctctcgcccatgctctacagcagctcagccagcctgtcaccttcagtaagcaagccgtgcacggtggaactgccacggctgactgatatggcaggcaccatgaatctgaatgatgggctgactgaaaacctcatggacgacctgctggataacatcacgctcccgccatcccagccatcgcccactgggggactcatgcagcggagctctagcttcccgtataccaccaagggctcgggcctgggctccccaaccagctcctttaacagcacggtgttcggaccttcatctctgaactccctacgccagtctcccatgcagaccatccaagagaacaagccagctaccttctcttccatgtcacactatggtaaccagacactccaggacctgctcacttcggactcacttagccacagcgatgtcatgatgacacagtcggaccccttgatgtctcaggccagcaccgctgtgtctgcccagaattcccgccggaacgtgatgcttcgcaatgatccgatgatgtcctttgctgcccagcctaaccagggaagtttggtcaatcagaacttgctccaccaccagcaccaaacccagggcgctcttggtggcagccgtgccttgtcgaattctgtcagcaacatgggcttgagtgagtccagcagccttgggtcagccaaacaccagcagcagtctcctgtcagccagtctatgcaaaccctctcggactctctctcaggctcctccttgtactcaactagtgcaaacctgcccgtcatgggccatgagaagttccccagcgacttggacctggacatgttcaatgggagcttggaatgtgacatggagtccattatccgtagtgaactcatggatgctgatgggttggattttaactttgattccctcatctccacacagaatgttgttggtttgaacgtggggaacttcactggtgctaagcaggcctcatctcagagctgggtgccaggctgaaggatcactgaggaaggggaagtgggcaaagcagaccctcaaactgacacaagacctacagagaaaaccctttgccaaatctgctctcagcaagtggacagtgataccgtttacagcttaacacctttgtgaatcccacgccattttcctaacccagcagagactgttaatggccccttaccctgggtgaagcacttacccttggaacagaactctaaaaagtatgcaaaatcttccttgtacagggtggtgagccgcctgccagtggaggacagcacccctcagcaccacccaccctcattcagagcacaccgtgagcccccgtcggccattctgtggtgttttaatattgcgatggtttatgggacgttttaagtgttgttcttgtgtttgttttcctttgactttctgagtttttcacatgcattaacttgcggtatttttctgttaaaatgttaaccgtccttcccctagcaaatttaaaaacagaaagaaaatgttgtaccagttaccattccgggttcgagcatcacaagcttttgagcgcatggaactccataaactaacaaattacataaactaaagggggattttctttcttcttttgtttggtagaaaattatccttttctaaaaactgaacaatggcacaattgtttgctatgtgcacccgtccaggacagaaccgtgcataggcaaaaggagtggagcacagcgtccggcccagtgtgtttccggttctgagtcagggtgatctgtggacgggaccccagcaccaagtctacgggtgccagatcagtagggcctgtgatttcctgtcagtgtcctcagctaatgtgaacagtgttggtctgctggttagaaactagaatattgatattttcaggaaagaaatcagctcagctctccactcattgccaaatgtcactaaagggtttagttttaaggagaaagaaaaggaaaaaaaaaaaaaaaa

SEQ ID NO: 135 - DNA, 1215 bp, Homo sapiens
aaatggaccgctccacacctgagctgccgccaagctaactcaatccgagccggcgcatttgagaaggcgcctgtgagggtcgctcctcagccgccgcgctcccactccgcgtccccactccgcgccgccgcgcctctgccagccccgaaggtggacgtgaagctccaacacctcgacttctgggcccgcctccatggccaggtcccgggactgctggactgggacatggggaacgagctctttctggccttcaccacatctcacctccccttagcggagcagaaacttgccaggtataaactccgaattgttaagccaccaaaattacccctagagaaaaaacccaaccctgataaggatggtccagattatgagcccaacctctggatgtgggtaaatcccaacattgtgtatccccctggaaagctggaggtctcaggacgtaggaagagggaggacctgacaagcacactcccctcctctcagccaccccagaaggaggaagatgccagctgctcagaggccgcaggggtggaatcactgtcccagtcctccagcaagcggtctccccctcggaagcggtttgccttttcccccagcacctgggagctcacagaagaggaggaggctgaggaccaggaagacagctcctctatggctctcccatcccctcacaaaagggcccccctccagagtcggaggcttcggcaagccagcagccaggcggggaggctctggtcccggccccctctcaattacttccacctaattgccctggcattaagaaacagttccccctgtggcctcaacgtgcaacagatctacagtttcactcgaaagcacttcccctttttccggacggccccggaaggctggaagaatactgtccgtcacaatctctgttttcgagacagctttgagaaagtgcctgtcagcatgcagggcggggccagcacacggcctcgatcttgcctctggaagttgaccgaggagggacaccgccgctttgcggaggaggcccgcgccttggcttccactcggctagaaagtatccaacagtgcatgagccagccagatgtgatgcccttcctctttgatctttaaccccaagaagcaacagccagctaatgctttattaaaattaccctcactaaaaaaaaaaaaaaaaaaaaaaaaaaaaaaaaaaaaaaaaaaaaaaaaaaaaaaaaaaaaaaa

SEQ ID NO: 136 - DNA, 1911 bp, Homo sapiens
ccctttccccactgtggtgtgataagaggctgccctcacagtcacaatgctcccgggtcacagaggtgctgggccccaggccagcctctgcctgggaagttctctctgggaacatctggtgggtactacaggccctattccaggccctatggcctgtggaacctcaccacgggggggagggctgggccagacggagacatcacctgtggtgtcagccccatggatgagacagagtggatacacagacatcccaaggctgaggacctaagggttgggctcatcagctgggcaggaacctacctcacctttgaggcatgcaagaatacagtcactgcaactgcgaagagtttgggcaggagacagacctgggagatcttggtgagcaatgagcatgagacacaggccgtggtgcgactaaagagcgtgcagggcctctacctgctgtgtgagtgtgatggcaccgtgtgttatggccgcccaaggaccagccaccatgggtgctttctactgcgtttccaccggaacagcaagtggaccctccagtgcctaatctctggtcgttatttggagtccaatggcaaggacgtgttttgcacttcccacgtcctctcagcttaccacatgtggaccccccgaccagccctccatgtccacgtgatcctctacagccccatccaccgctgctatgcccgggctgaccccactatgggccgcatctgggtggacgcagcagttccctgcctggaggagtgtggcttcctgttgcatttccgagatggatgctaccacctggagacctctacacaccacttcttgtcccatgtagaccggctgttctcccaaccctcatcacagacagcttttcacatgcaagtgcggcctggagggcttgtggcactgtgtgatggagaaggaggcatgttatatccacagggcacgcatctgctcttgggcatgggctgcaaccccatgaggggtgaggagtggttcatcctacagcactgcccaacctgggtcagcctcaggtcaaagactgggcggttcatctcagtcatctacgatggtgaggtgcgtgctgcttctgagcgcttaaaccgaatgtccttgttccagtttgaatgtgacagtgagagccccactgtgcagcttcgttcagccaatggctactacctatcccagaggcgccacagggcagtaatggctgatgggcaccccctggagtctgacacgttcttccgaatgcactggaactgtggcaggatcatcctgcagtcctgcagggggcgcttcctgggcattgcacccaacagcctgctgatggccaatgtcatccttccaggcccaaatgaggaatttgggattttatttgccaatcgctccttccttgtattgcgaggtcgttatggctatgtgggctcctcatcgggccatgacctcatacagtgcaaccaggatcagcccgaccgcattcatctactaccctgccgaccgggtatctaccacttccaggcacaggggggatccttctggtcaataacatcctttggcacctttcgcccttggggcaagtttgccctcaacttctgtatcgagcttcaggggagcaacttactcactgtactggcccccaatggcttctacatgcgagccgaccaaagtggcaccctgttggcagacagtgaagacattaccagagagtgtatctgggaattttaggtcaatgggatgtcacctaccaaaatccaaatcctccaggaaaaactactacactaaatggaccaggaacctcagagtcaagatccaagagaagaacatctgttacaacttttcctacccagtttagcaaaacacctgttttatgcaacaatacatcacaacaggccacccccaaaaaaaaaaaaaaaaaaaaaa

SEQ ID NO: 137 - DNA, 2607 bp, Homo sapiens
catctgcaaacatcccaaaacctttcaaccaaaatatgtatagatgagtgtgcagaccaaagtaaggacatcagtatgttacatttaaaaataagtcaaggttaaaggcggtgtcctcttttaagaacatcgcaaatacaattccagtactccaagtacgtattctgtacccagccacctgggaggactgagagacctaatggttttctgctttctggaacttctatgccaattgtgactttctcacccaaatttgtaaattcgcaaattaacatgcagcgaataattacaattgtaaacacctggaagtggaaaaggccgtgaggataaattgagaggaagagtaaacctaataccataagttgcataccagcagatctgagtatcgtcatgaataattggttagcttttccacatgccttagaagtttcagcaagcacctagcgaacatcttaatccaaatttctcaaaaaatgagagattttatttaagatcattcctcaatttatcttagactttcagctacatagttagtccggtagtgtaacagtaacgggttttacgtaaatgccaggggaaaagagaggaaagctaaataaccaagtaaatctgtatctaattaacaaattggctaaataaggtgttatcagctgcttgatatagagctgataaaatcttcagctaggcatacttgaggcctgattacagaagtgaccgtagtccacccacacacctgaaatttatttaagagaccaagctaggctcttcctggcctttaggaagaggactggcatggagaaatatgttcctcactagttctcccaagccatggcacgtcccaacaaattcctcctttggttttgctgctttgcctggctgtgttttcctattagccttggttctcaggcttctgggggagaagctcagattgctgctagtgctgagttggaatctggggctatgccttggtccttgctgcagcatatagatgagagagacagagctggcctccttcccgcgcttttcaaagttctatctgttgggcgaggtgggtcacctaggctgcagccagactccagagctttgcactacatgaagaagctctataagacatatgctaccaaggaagggattcctaaatccaatagaagtcacctctacaacactgttcggctcttcaccccctgtacccggcacaagcaggctcctggagaccaggtaacaggaatccttccatcagtggaactgctatttaacctggatcgcattactaccgttgaacacttactcaagtcagtcttgctgtacaatatcaacaactcagtttctttttcctctgctgtcaaatgtgtgtgcaatctaatgataaaggagccaaagtcttctagcaggactctcggcagagctccatactcatttacctttaactcacagtttgaatttggaaagaaacacaaatggattcagattgatgtgaccagcctccttcaacctttagtggcctccaacaagagaagtattcacatgtctataaattttacttgcatgaaagaccagctggagcatccttcagcacagaatggtttgtttaacatgactctggtgtccccctcactgatcttatatttgaatgacacaagtgctcaggcttatcacagctggtattcccttcactataaaaggaggccttcccagggtcctgaccaggagagaagtctgtctgcctatcctgtgggagaagaggctgctgaggatgggagatcttcccatcaccgtcaccgcagaggtcaggaaactgtcagttctgaattgaagaagcccttgggcccagcttccttcaatctgagtgaatacttcagacaatttcttcttccccaaaatgagtgtgagctccatgactttagacttagctttagtcagctgaagtgggacaactggattgtggctccgcacaggtacaaccctcgatactgtaaaggggactgtccaagggcagttggacatcggtatggctctccagttcacaccatggtacagaacatcatctatgagaagctggactcctcagtgccaagaccgtcatgtgtacctgccaaatacagccccttgagtgttttgaccattgagcccgatggctcaattgcctataaagagtacgaagatatgatagctacaaagtgcacctgtcgttaacaaatggtcctcttaaaaccttgagcctatttggcaaagtaactactgtgtgcctatgtgtgccttcaagagaaagcttcatatattaagtctctaaatgtagcatatgttatataaagaggagcctgtgtaggttagtaccttctatggcatctatcaggataaagggataacatcaattgttgctacagagcctttttttatttccaaatttaaatgaaatataattattgtggagaactttacatttttttccttgagtgattttttttcttttcataggagtcttattcttgatagggaaaaaaccttaattagcatcaatcctggatggacttgcagctataaataggcaattcagattgctgtagtcttaatagaagaataaatttctgtcaatggcataaaaaaaaa

SEQ ID NO: 138 - DNA, 1832 bp, Homo sapiens
cattgtggcggcggccctgcaggaccgagggtggacaggcgcttggctcgctttcgcgaagcgccgcagtccccgcgggggtccatccccaaccccagactcctgcccctgcactccttatcctttcccagcccagcggggcgcccctagcctcccagggtccacgaacactgcacaaccagaccccactcacgcacagggctcagctcgccctccacagtcaccgatccggttgactcgttcgtcatttccggcaaggttggaagccgctcttggaggtcgtgaggctgcagccagactccagagctttgcactacatgaagaagctctataagacatatgctaccaaggaagggattcctaaatccaatagaagtcacctctacaacactgttcggctcttcaccccctgtacccggcacaagcaggctcctggagaccaggtaacaggaatccttccatcagtggaactgctatttaacctggatcgcattactaccgttgaacacttactcaagtcagtcttgctgtacaatatcaacaactcagtttctttttcctctgctgtcaaatgtgtgtgcaatctaatgataaaggagccaaagtcttctagcaggactctcggcagagctccatactcatttacctttaactcacagtttgaatttggaaagaaacacaaatggattcagattgatgtgaccagcctccttcaacctttagtggcctccaacaagagaagtattcacatgtctataaattttacttgcatgaaagaccagctggagcatccttcagcacagaatggtttgtttaacatgactctggtgtccccctcactgatcttatatttgaatgacacaagtgctcaggcttatcacagctggtattcccttcactataaaaggaggccttcccagggtcctgaccaggagagaagtctgtctgcctatcctgtgggagaagaggctgctgaggatgggagatcttcccatcaccgtcaccgcagaggtcaggaaactgtcagttctgaattgaagaagcccttgggcccagcttccttcaatctgagtgaatacttcagacaatttcttcttccccaaaatgagtgtgagctccatgactttagacttagctttagtcagctgaagtgggacaactggattgtggctccgcacaggtacaaccctcgatactgtaaaggggactgtccaagggcagttggacatcggtatggctctccagttcacaccatggtacagaacatcatctatgagaagctggactcctcagtgccaagaccgtcatgtgtacctgccaaatacagccccttgagtgttttgaccattgagcccgatggctcaattgcctataaagagtacgaagatatgatagctacaaagtgcacctgtcgttaacaaatggtcctcttaaaaccttgagcctatttggcaaagtaactactgtgtgcctatgtgtgccttcaagagaaagcttcatatattaagtctctaaatgtagcatatgttatataaagaggagcctgtgtaggttagtaccttctatggcatctatcaggataaagggataacatcaattgttgctacagagcctttttttatttccaaatttaaatgaaatataattattgtggagaactttacatttttttccttgagtgattttttttcttttcataggagtcttattcttgatagggaaaaaaccttaattagcatcaatcctggatggacttgcagctataaataggcaattcagattgctgtagtcttaatagaagaataaatttctgtcaatggcataaaaaaaaa

SEQ ID NO: 139 - DNA, 1948 bp, Homo sapiens
cattgtggcggcggccctgcaggaccgagggtggacaggcgcttggctcgctttcgcgaagcgccgcagtccccgcgggggtccatccccaaccccagactcctgcccctgcactccttatcctttcccagcccagcggggcgcccctagcctcccagggtccacgaacactgcacaaccagaccccactcacgcacagggctcagctcgccctccacagtcaccgatccggttgactcgttcgtcatttccggcaaggttggaagccgctcttggaggtcgtgagcctggtctcagctccaaggcaagaacagaaatacagcatatagatgagagagacagagctggcctccttcccgcgcttttcaaagttctatctgttgggcgaggtgggtcacctaggctgcagccagactccagagctttgcactacatgaagaagctctataagacatatgctaccaaggaagggattcctaaatccaatagaagtcacctctacaacactgttcggctcttcaccccctgtacccggcacaagcaggctcctggagaccaggtaacaggaatccttccatcagtggaactgctatttaacctggatcgcattactaccgttgaacacttactcaagtcagtcttgctgtacaatatcaacaactcagtttctttttcctctgctgtcaaatgtgtgtgcaatctaatgataaaggagccaaagtcttctagcaggactctcggcagagctccatactcatttacctttaactcacagtttgaatttggaaagaaacacaaatggattcagattgatgtgaccagcctccttcaacctttagtggcctccaacaagagaagtattcacatgtctataaattttacttgcatgaaagaccagctggagcatccttcagcacagaatggtttgtttaacatgactctggtgtccccctcactgatcttatatttgaatgacacaagtgctcaggcttatcacagctggtattcccttcactataaaaggaggccttcccagggtcctgaccaggagagaagtctgtctgcctatcctgtgggagaagaggctgctgaggatgggagatcttcccatcaccgtcaccgcagaggtcaggaaactgtcagttctgaattgaagaagcccttgggcccagcttccttcaatctgagtgaatacttcagacaatttcttcttccccaaaatgagtgtgagctccatgactttagacttagctttagtcagctgaagtgggacaactggattgtggctccgcacaggtacaaccctcgatactgtaaaggggactgtccaagggcagttggacatcggtatggctctccagttcacaccatggtacagaacatcatctatgagaagctggactcctcagtgccaagaccgtcatgtgtacctgccaaatacagccccttgagtgttttgaccattgagcccgatggctcaattgcctataaagagtacgaagatatgatagctacaaagtgcacctgtcgttaacaaatggtcctcttaaaaccttgagcctatttggcaaagtaactactgtgtgcctatgtgtgccttcaagagaaagcttcatatattaagtctctaaatgtagcatatgttatataaagaggagcctgtgtaggttagtaccttctatggcatctatcaggataaagggataacatcaattgttgctacagagcctttttttatttccaaatttaaatgaaatataattattgtggagaactttacatttttttccttgagtgattttttttcttttcataggagtcttattcttgatagggaaaaaaccttaattagcatcaatcctggatggacttgcagctataaataggcaattcagattgctgtagtcttaatagaagaataaatttctgtcaatggcataaaaaaaaa

SEQ ID NO: 140 - DNA, 794 bp, Homo sapiens
attcggcacgaggggaaagagggtcgtggtattgtaagcccagccggtagtgcccattctttttggggttaaaggtatgtcggatttagttctaggtgtgacggctgtgtgtctgtctgtgtgtgtacaaggctgtgtgcatctgcggtgtcagtgtgtgactttggtatgtttgtgtgtcggtgggaacgtgttaggtccacgtgccggtgggtgtatgtgaatgtgtctggttgggtgcctcctggcctacctttgtcatccctggggggcgacagctctggggtctggccaggccgctccagggcagtgggtgagcgccgctcttcccgctcgcaggcaaacctctactctggagccccttcttgcagaggcctctgcataaaaggaaaggcggccaggtgagattctccaacgaccagaccatcgagctggagaagaaattcgagacgcagaaatatctctctccgcccgagaggaagcgtctggccaagatgctgcagctcagcgagagacaggtcaaaacctggtttcagaatcgacgcgctaaatggaggagactaaaacaggagaaccctcaaagcaataaaaaagaagaactggaaagtttggacagttcctgtgatcagaggcaagatttgcccagtgaacagaataaaggtgcttctttggatagctctcaatgttcgccctcccctgcctcccaggaagaccttgaatcagagatttcagaggattctgatcaggaagtggacattgagggcgataaaagctattttaatgctggatgatga

SEQ ID NO: 141 - DNA, 2374 bp, Homo sapiens
ttggctgtcagtcggatccgagaacgacgattggctttccttgaccgtccctcaagcgcctctccggagatggtctgaggtgggagaagagctgaagagacctggagccgacagacgggtctgggtctgccgcccaggatggagtacaatggtgtgatcttggctctttgcaacctctgcctcctgggctcaagccttcctcccacctgaacctcccaagtagcgggactgcagggtgaaggccatgccgcctcctgggaaagttccccgaaaggagaatctgtggctacagtgtgagtgggggtcctgctcctttgtgtgctcaaccatggaaaagttctttgagcatgtcactcagcacctgcagcagcacctgcatggctctggggaggaggaggaagaggaagaggaggatgacccacttgaggaagaattctcctgcttgtggcaggaatgtggcttttgttctctggacagttctgctgacctcatccgccatgtctacttccactgctaccacaccaagctgaaacagtgggggctgcaggccttgcaaagccaggctgaccttggcccctgcatcctggacttccagagccggaacgtcatccctgatatccctgaccacttcctgtgtctgtgggagcactgtgagaattccttcgacaatcctgagtggttttatcggcatgtggaagcacacagtctgtgctgtgaatacgaagcagtcggcaaggacaacccggtggtgctgtgtggctggaaaggctgtacctgcaccttcaaggaccgcagtaaacttcgagagcacctccgcagccatacccaggagaaagtggtagcctgccccacctgtgggggcatgtttgccaacaataccaagttcttagatcacatccgtcgccagacctcattggatcagcagcacttccagtgttctcactgttccaagagatttgccacagagcggctattgcgggaccacatgcgcaaccatgtgaatcactataagtgccctctgtgtgacatgacctgcccgctgccttcctccctccgcaaccacatgcgctttcgtcacagtgaggaccggccctttaaatgtgactgttgtgactacagctgcaagaatcttattgacctccagaagcacctggatacccacagcgaggagccagcctacaggtgtgattttgagaactgcaccttcagtgcccgatccctctgctctatcaagtcccattaccgcaaagtacatgaaggagactctgagccaaggtacaaatgtcatgtgtgtgacaaatgcttcacacggggcaacaacctcaccgtgcaccttcgcaagaagcaccagttcaagtggccctcagggcatccccgttttcggtacaaggaacatgaagatggctatatgcggctgcagctggttcgctacgagagtgtagagctgacacagcaactgctgcggcaaccacaagagggatcgggcctgggaacgtcgctgaacgagagcagcctgcagggcattattctagaaacagtgccaggggagccaggacgtaaggaagaggaagaggagggcaagggtagcgaagggacagccctctcagcctctcaggacaaccccagttctgtcatccacgtggtgaatcagaccaatgcccaaggccagcaagagattgtctactatgtgctgtctgaagccccaggggagcctcccccagcccctgagccaccttcagggggcatcatggaaaagcttcaaggaatagctgaggagccagagatccagatggtttgaaggccgcagagccagaccatttcttccccaggtcctgaagtttgagccaggcaagtggcagtgcccctagtgggcagccgttgccaatggatgcctttaggagtggtgccgagagcagtgtggtccactctggcctgggtttgcatcattctgcagactctaaagacttcccttttctgccagactacattttgtggggagcctgaggactctggattctttgaggggatcctggatgtgtgtgttcttgttaaagaggctgttatcaggcttaaccataaccctcaagatctgcttgacagtgattaaatccttagctcacatccattcccatctttcgggctccttaggcccaaggatggcatgtgactggtccctgcaagggtcctttctttgtcaccagccaaggcattgataaccaagtagccattttcctcttaaggtttcctctacaaccccaaggactttcatgattatcctcagggacaggattggaggcattgagcgtgtttattaacaaattgtttttggtaataaaataaatgcttggactcttaaaaaaaaaaaaaaaaaaaa

SEQ ID NO: 142 - DNA, 2257 bp, Homo sapiens
ttggctgtcagtcggatccgagaacgacgattggctttccttgaccgtccctcaagcgcctctccggagatggtctgaggtgggagaagagctgaagagacctggagccgacagacgggtgaaggccatgccgcctcctgggaaagttccccgaaaggagaatctgtggctacagtgtgagtgggggtcctgctcctttgtgtgctcaaccatggaaaagttctttgagcatgtcactcagcacctgcagcagcacctgcatggctctggggaggaggaggaagaggaagaggaggatgacccacttgaggaagaattctcctgcttgtggcaggaatgtggcttttgttctctggacagttctgctgacctcatccgccatgtctacttccactgctaccacaccaagctgaaacagtgggggctgcaggccttgcaaagccaggctgaccttggcccctgcatcctggacttccagagccggaacgtcatccctgatatccctgaccacttcctgtgtctgtgggagcactgtgagaattccttcgacaatcctgagtggttttatcggcatgtggaagcacacagtctgtgctgtgaatacgaagcagtcggcaaggacaacccggtggtgctgtgtggctggaaaggctgtacctgcaccttcaaggaccgcagtaaacttcgagagcacctccgcagccatacccaggagaaagtggtagcctgccccacctgtgggggcatgtttgccaacaataccaagttcttagatcacatccgtcgccagacctcattggatcagcagcacttccagtgttctcactgttccaagagatttgccacagagcggctattgcgggaccacatgcgcaaccatgtgaatcactataagtgccctctgtgtgacatgacctgcccgctgccttcctccctccgcaaccacatgcgctttcgtcacagtgaggaccggccctttaaatgtgactgttgtgactacagctgcaagaatcttattgacctccagaagcacctggatacccacagcgaggagccagcctacaggtgtgattttgagaactgcaccttcagtgcccgatccctctgctctatcaagtcccattaccgcaaagtacatgaaggagactctgagccaaggtacaaatgtcatgtgtgtgacaaatgcttcacacggggcaacaacctcaccgtgcaccttcgcaagaagcaccagttcaagtggccctcagggcatccccgttttcggtacaaggaacatgaagatggctatatgcggctgcagctggttcgctacgagagtgtagagctgacacagcaactgctgcggcaaccacaagagggatcgggcctgggaacgtcgctgaacgagagcagcctgcagggcattattctagaaacagtgccaggggagccaggacgtaaggaagaggaagaggagggcaagggtagcgaagggacagccctctcagcctctcaggacaaccccagttctgtcatccacgtggtgaatcagaccaatgcccaaggccagcaagagattgtctactatgtgctgtctgaagccccaggggagcctcccccagcccctgagccaccttcagggggcatcatggaaaagcttcaaggaatagctgaggagccagagatccagatggtttgaaggccgcagagccagaccatttcttccccaggtcctgaagtttgagccaggcaagtggcagtgcccctagtgggcagccgttgccaatggatgcctttaggagtggtgccgagagcagtgtggtccactctggcctgggtttgcatcattctgcagactctaaagacttcccttttctgccagactacattttgtggggagcctgaggactctggattctttgaggggatcctggatgtgtgtgttcttgttaaagaggctgttatcaggcttaaccataaccctcaagatctgcttgacagtgattaaatccttagctcacatccattcccatctttcgggctccttaggcccaaggatggcatgtgactggtccctgcaagggtcctttctttgtcaccagccaaggcattgataaccaagtagccattttcctcttaaggtttcctctacaaccccaaggactttcatgattatcctcagggacaggattggaggcattgagcgtgtttattaacaaattgtttttggtaataaaataaatgcttggactcttaaaaaaaaaaaaaaaaaaaa

SEQ ID NO: 143 - DNA, 2319 bp, Homo sapiens
ttggctgtcagtcggatccgagaacgacgattggctttccttgaccgtccctcaagcgcctctccggagatggtctgaggtgggagaagagctgaagagacctggagccgacagacgggtgaaggccatgccgcctcctgggaaagttccccgaaaggagaatctgtggctacagtgtgagtgggggtcctgctcctttgtgtgctcaaccatggaaaagttctttgagcatgtcactcagcacctgcagcagcacctgcatggctctggggaggaggaggaagaggaagaggaggatgacccacttgaggaagaattctcctgcttgtggcaggaatgtggcttttgttctctggacagttctgctgacctcatccgccatgtctacttccactgctaccacaccaagctgaaacagtgggggctgcaggccttgcaaagccaggctgaccttggcccctgcatcctggacttccagagccggaacgtcatccctgatatccctgaccacttcctgtgtctgtgggagcactgtgagaattccttcgacaatcctgagtggttttatcggcatgtggaagcacacagtctgtgctgtgaatacgaagcagtcggcaaggacaacccggtggtgctgtgtggctggaaaggctgtacctgcaccttcaaggaccgcagtaaacttcgagagcacctccgcagccatacccaggagaaagtggtagcctgccccacctgtgggggcatgtttgccaacaataccaagttcttagatcacatccgtcgccagacctcattggatcagcagcacttccagtgttctcactgttccaagagatttgccacagagcggctattgcgggaccacatgcgcaaccatgtgaatcactataagtgccctctgtgtgacatgacctgcccgctgccttcctccctccgcaaccacatgcgctttcgtcacagtgaggaccggccctttaaatgtgactgttgtgactacagctgcaagaatcttattgacctccagaagcacctggatacccacagcgaggagccagcctacaggtgtgattttgagaactgcaccttcagtgcccgatccctctgctctatcaagtcccattaccgcaaagtacatgaaggagactctgagccaaggtacaaatgtcatgtgtgtgacaaatgcttcacacggggcaacaacctcaccgtgcaccttcgcaagaagcaccagttcaagtggccctcagggcatccccgttttcgcctcggccatttctgtatccccctgcctgggtttgctgccctttatgctcctacctcaccaggtacaaggaacatgaagatggctatatgcggctgcagctggttcgctacgagagtgtagagctgacacagcaactgctgcggcaaccacaagagggatcgggcctgggaacgtcgctgaacgagagcagcctgcagggcattattctagaaacagtgccaggggagccaggacgtaaggaagaggaagaggagggcaagggtagcgaagggacagccctctcagcctctcaggacaaccccagttctgtcatccacgtggtgaatcagaccaatgcccaaggccagcaagagattgtctactatgtgctgtctgaagccccaggggagcctcccccagcccctgagccaccttcagggggcatcatggaaaagcttcaaggaatagctgaggagccagagatccagatggtttgaaggccgcagagccagaccatttcttccccaggtcctgaagtttgagccaggcaagtggcagtgcccctagtgggcagccgttgccaatggatgcctttaggagtggtgccgagagcagtgtggtccactctggcctgggtttgcatcattctgcagactctaaagacttcccttttctgccagactacattttgtggggagcctgaggactctggattctttgaggggatcctggatgtgtgtgttcttgttaaagaggctgttatcaggcttaaccataaccctcaagatctgcttgacagtgattaaatccttagctcacatccattcccatctttcgggctccttaggcccaaggatggcatgtgactggtccctgcaagggtcctttctttgtcaccagccaaggcattgataaccaagtagccattttcctcttaaggtttcctctacaaccccaaggactttcatgattatcctcagggacaggattggaggcattgagcgtgtttattaacaaattgtttttggtaataaaataaatgcttggactcttaaaaaaaaaaaaaaaaaaaa

SEQ ID NO: 144 - DNA, 2330 bp, Homo sapiens
ttggctgtcagtcggatccgagaacgacgattggctttccttgaccgtccctcaagcgcctctccggagatggtctgaggtgggagaagagctgaagagacctggagccgacagacggtaagctgggggtgaaggccatgccgcctcctgggaaagttccccgaaaggagaatctgtggctacagtgtgagtgggggtcctgctcctttgtgtgctcaaccatggaaaagttctttgagcatgtcactcagcacctgcagcagcacctgcatggctctggggaggaggaggaagaggaagaggaggatgacccacttgtgctgcaggtggaaggtgacctgagccttggaaagtgtcagactcttccttttaaacccctttctacagaggaagaattctcctgcttgtggcaggaatgtggcttttgttctctggacagttctgctgacctcatccgccatgtctacttccactgctaccacaccaagctgaaacagtgggggctgcaggccttgcaaagccaggctgaccttggcccctgcatcctggacttccagagccggaacgtcatccctgatatccctgaccacttcctgtgtctgtgggagcactgtgagaattccttcgacaatcctgagtggttttatcggcatgtggaagcacacagtctgtgctgtgaatacgaagcagtcggcaaggacaacccggtggtgctgtgtggctggaaaggctgtacctgcaccttcaaggaccgcagtaaacttcgagagcacctccgcagccatacccaggagaaagtggtagcctgccccacctgtgggggcatgtttgccaacaataccaagttcttagatcacatccgtcgccagacctcattggatcagcagcacttccagtgttctcactgttccaagagatttgccacagagcggctattgcgggaccacatgcgcaaccatgtgaatcactataagtgccctctgtgtgacatgacctgcccgctgccttcctccctccgcaaccacatgcgctttcgtcacagtgaggaccggccctttaaatgtgactgttgtgactacagctgcaagaatcttattgacctccagaagcacctggatacccacagcgaggagccagcctacaggtgtgattttgagaactgcaccttcagtgcccgatccctctgctctatcaagtcccattaccgcaaagtacatgaaggagactctgagccaaggtacaaatgtcatgtgtgtgacaaatgcttcacacggggcaacaacctcaccgtgcaccttcgcaagaagcaccagttcaagtggccctcagggcatccccgttttcggtacaaggaacatgaagatggctatatgcggctgcagctggttcgctacgagagtgtagagctgacacagcaactgctgcggcaaccacaagagggatcgggcctgggaacgtcgctgaacgagagcagcctgcagggcattattctagaaacagtgccaggggagccaggacgtaaggaagaggaagaggagggcaagggtagcgaagggacagccctctcagcctctcaggacaaccccagttctgtcatccacgtggtgaatcagaccaatgcccaaggccagcaagagattgtctactatgtgctgtctgaagccccaggggagcctcccccagcccctgagccaccttcagggggcatcatggaaaagcttcaaggaatagctgaggagccagagatccagatggtttgaaggccgcagagccagaccatttcttccccaggtcctgaagtttgagccaggcaagtggcagtgcccctagtgggcagccgttgccaatggatgcctttaggagtggtgccgagagcagtgtggtccactctggcctgggtttgcatcattctgcagactctaaagacttcccttttctgccagactacattttgtggggagcctgaggactctggattctttgaggggatcctggatgtgtgtgttcttgttaaagaggctgttatcaggcttaaccataaccctcaagatctgcttgacagtgattaaatccttagctcacatccattcccatctttcgggctccttaggcccaaggatggcatgtgactggtccctgcaagggtcctttctttgtcaccagccaaggcattgataaccaagtagccattttcctcttaaggtttcctctacaaccccaaggactttcatgattatcctcagggacaggattggaggcattgagcgtgtttattaacaaattgtttttggtaataaaataaatgcttggactcttaaaaaaaaaaaaaa

SEQ ID NO: 145 - DNA, 1083 bp, Homo sapiens
atccgcccaggcatgtgcacacacacatgcatatgtgcacgcaccgtgcaggcccgctgtctggcccacaagcgcagccctcctccccaggacacctggcatgttacatgcctccaccatctggcatctccggtccacccctccccggaggaaacaatggggccactgtgacccacacagaattctggtagcctctgaggtcaccacagagataacctcaccaacccctgcaccaagagcacaagtctgtggaggccagccgtgggtgaccgtccttgatcctctttctggccacacaggtaaaggtgagggccggagctcaagaggaagcctcagcgaggaccaggaaccgggacacacctcagccatcctgtgaggggcagcccagtggagacttccagccgccctggaggtccttgcacccaagacacttcacctaccccagggagagaagcagaaaggcacttcgccactgtctccatcagtgctgttgaactcaaatactgccatgggtggaggccagcagggcagcgtgtccctagcaagacagcgactgggcaacgcacctgtgccaaaccctgccagaagcccagcacgtccaaggtgatcctgagggctgtggcggacaaggggacctgcaagtatgtgtccctggccaccctgaagaaggctgtttccaccacgggctacgacatggcccgaaatgcctatcacttcaagcgtgtgctcaaggggctggtggacaagggctcagcaggtgaccggcaggggggcctcaggctccttcaccctgggcaagaagcaggcctccaagtccaagctcaaggtcaagaggcaacgacagcagaggtggcgctctgggcagcgcccctttggacagcacaggtcactactgggctccaaacaggggcacaagcggcttatcaagggggttcgaagggtggccaagtgccactgcaattaatgaggcaggccaggcaagcagtcaggggtgccaagaccgccattggctcagtgcagtgggaataaaaggaacataacttatttcaaaaaaaaaaaaaaaaaaaaaaaaaaaaaaaaaaa

SEQ ID NO: 146 - DNA, 2561 bp, Homo sapiens
attcatatcatttttcttctccggccccatggaggaagtgagaaagttggcacagtcacgccgggcttcgcaggaccaggtcactcagtgacagatggacaatgcaagaatgaactccttcctggaataccccatacttagcagtggcgactcggggacctgctcagcccgagcctacccctcggaccataggattacaactttccagtcgtgcgcggtcagcgccaacagttgcggcggcgacgaccgcttcctagtgggcaggggggtgcagatcggttcgccccaccaccaccaccaccaccaccatcaccacccccagccggctacctaccagacttccgggaacctgggggtgtcctactcccactcaagttgtggtccaagctatggctcacagaacttcagtgcgccttacagcccctacgcgttaaatcaggaagcagacgtaagtggtgggtacccccagtgcgctcccgctgtttactctggaaatctctcatctcccatggtccagcatcaccaccaccaccagggttatgctgggggcgcggtgggctcgcctcaatacattcaccactcatatggacaggagcaccagagcctggccctggctacgtataataactccttgtcccctctccacgccagccaccaagaagcctgtcgctcccccgcatcggagacatcttctccagcgcagacttttgactggatgaaagtcaaaagaaaccctcccaaaacagggaaagttggagagtacggctacctgggtcaacccaacgcggtgcgcaccaacttcactaccaagcagctcacggaactggagaaggagttccacttcaacaagtacctgacgcgcgcccgcagggtggagatcgctgcatccctgcagctcaacgagacccaagtgaagatctggttccagaaccgccgaatgaagcaaaagaaacgtgagaaggagggtctcttgcccatctctccggccaccccgccaggaaacgacgagaaggccgaggaatcctcagagaagtccagctcttcgccctgcgttccttccccggggtcttctacctcagacactctgactacctcccactgaggcggctccagccccagacaacagcccaggcatctccttgggctgggacttcttacccaaagcacatgcttagcttatctttctttccatttacagtctctttcttcctttctaatcctatctggggagctcctggccaggataatatatttgcagataattctggaccagagacttggtgcggggttaacaccttcatccagattgggtgccagcatacattttctggtgggccttaacatccctcctgcttttaggagaattcacagaacctactgttcctttcagatgaccttttggaaaatagttccctttgccaacagaaacatgccagaaggaatcttctcatcttttatctaactatatgtacagctctcccctcccttgtccttgaaagtaggatatagcgaaaggcgagtccaggagctcaggaagaagagatgcactatatgtttacacaattaattcatcccttaatttaagtcattttcatgtgtgtgagtttgctggttgtaaatactttgtcctaagagatttatctttatacagattttctagaaatgtttaggttactaaaacagggtgggcaaactctctaaactggtacaattttataggtgaaagaaaaaattccctcatttaaacccaatcagatgcctcagagggtagccttgatttgttcttacagttaagaagccctgcagagcacaaacttcagaaacccggcttcctgtgctaagtctttcccaatctctacccctttcttctcgggccaccctctgtttaaaatttgtgctgggttattcagaacctaaaagtattattcaaaccaatttcttccttccacagttatcttagctggatataatgtattttcagctcaattgttaatgtgatggatggcacaatgaatgtatattttgtgttattcgtgaatagtcttttgcatgtcgcacaatgtttgatgtccccaaagtaccacactgagttctatcagttatcctttgtgagcctatgatattccccatttcctgtacaatcatgaacagctctgagatcctggagtgatatgatccagagcagagtttacgggtcttaggatgtctgtaataaataaatatactcaagtttcaggtatgcttaagcatccgtgtatttggctgggctacaatttgttaattcctatgaagttggcacatttcatgaggggaaagggagaagggtggtaaatattttcaaagagatgggccttttcttgaataaaagttaataacagctcctttattataatcaaagctcataatggaaaaaaagactgatgaagaaatttatgaagcagatttatttttgaaacaaacatggatacttcctgggtcaagtgctaaccttttcacctccaactggatgttgacgtatatataaacagaactcccttcaaaagccaaaaaaaaaaaaaaaa

SEQ ID NO: 147 - DNA, 2358 bp, Homo sapiens
attcatatcatttttcttctccggccccatggaggaagtgagaaagttggcacagtcacgccgggcttcgcaggaccaggtcactcagtgacagatggacaatgcaagaatgaactccttcctggaataccccatacttagcagtggcgactcggggacctgctcagcccgagcctacccctcggaccataggattacaactttccagtcgtgcgcggtcagcgccaacagttgcggcggcgacgaccgcttcctagtgggcaggggggtgcagatcggttcgccccaccaccaccaccaccaccaccatcaccacccccagccggctacctaccagacttccgggaacctgggggtgtcctactcccactcaagttgtggtccaagctatggctcacagaacttcagtgcgccttacagcccctacgcgttaaatcaggaagcagacccaccaagaagcctgtcgctcccccgcatcggagacatcttctccagcgcagacttttgactggatgaaagtcaaaagaaaccctcccaaaacagggaaagttggagagtacggctacctgggtcaacccaacgcggtgcgcaccaacttcactaccaagcagctcacggaactggagaaggagttccacttcaacaagtacctgacgcgcgcccgcagggtggagatcgctgcatccctgcagctcaacgagacccaagtgaagatctggttccagaaccgccgaatgaagcaaaagaaacgtgagaaggagggtctcttgcccatctctccggccaccccgccaggaaacgacgagaaggccgaggaatcctcagagaagtccagctcttcgccctgcgttccttccccggggtcttctacctcagacactctgactacctcccactgaggcggctccagccccagacaacagcccaggcatctccttgggctgggacttcttacccaaagcacatgcttagcttatctttctttccatttacagtctctttcttcctttctaatcctatctggggagctcctggccaggataatatatttgcagataattctggaccagagacttggtgcggggttaacaccttcatccagattgggtgccagcatacattttctggtgggccttaacatccctcctgcttttaggagaattcacagaacctactgttcctttcagatgaccttttggaaaatagttccctttgccaacagaaacatgccagaaggaatcttctcatcttttatctaactatatgtacagctctcccctcccttgtccttgaaagtaggatatagcgaaaggcgagtccaggagctcaggaagaagagatgcactatatgtttacacaattaattcatcccttaatttaagtcattttcatgtgtgtgagtttgctggttgtaaatactttgtcctaagagatttatctttatacagattttctagaaatgtttaggttactaaaacagggtgggcaaactctctaaactggtacaattttataggtgaaagaaaaaattccctcatttaaacccaatcagatgcctcagagggtagccttgatttgttcttacagttaagaagccctgcagagcacaaacttcagaaacccggcttcctgtgctaagtctttcccaatctctacccctttcttctcgggccaccctctgtttaaaatttgtgctgggttattcagaacctaaaagtattattcaaaccaatttcttccttccacagttatcttagctggatataatgtattttcagctcaattgttaatgtgatggatggcacaatgaatgtatattttgtgttattcgtgaatagtcttttgcatgtcgcacaatgtttgatgtccccaaagtaccacactgagttctatcagttatcctttgtgagcctatgatattccccatttcctgtacaatcatgaacagctctgagatcctggagtgatatgatccagagcagagtttacgggtcttaggatgtctgtaataaataaatatactcaagtttcaggtatgcttaagcatccgtgtatttggctgggctacaatttgttaattcctatgaagttggcacatttcatgaggggaaagggagaagggtggtaaatattttcaaagagatgggccttttcttgaataaaagttaataacagctcctttattataatcaaagctcataatggaaaaaaagactgatgaagaaatttatgaagcagatttatttttgaaacaaacatggatacttcctgggtcaagtgctaaccttttcacctccaactggatgttgacgtatatataaacagaactcccttcaaaagccaaaaaaaaaaaaaaaa

SEQ ID NO: 148 - DNA, 2064 bp, Homo sapiens
aaaatggggtttggtgtaaatctgggggtgtaatgttatcatatatcactctacctcgtaaaaccgacactgaaagctgccggacaacaaatcacaggtcaaaattatgagttcttcgtattatgtgaacgcgctttttagcaaatatacggcggggacttctctgttccaaaatgccgagccgacttcttgctcctttgcgcccaactcacagagaagcggctacggggcgggcgccggcgccttcgcctcgaccgttccgggcttatacaatgtcaacagccccctttatcagagcccctttgcgtccggctacggcctgggcgccgacgcctacggcaacctgccctgcgcctcctacgaccaaaacatccccgggctctgcagtgacctcgccaaaggcgcctgcgacaagacggacgagggcgcgctgcatggcgcggctgaggccaatttccgcatctacccctggatgcggtcttcaggacctgacaggaagcggggccgccagacctacacgcgctaccagacgctggagctggagaaggagttccacttcaaccgctacctgacccggcgccgccgcattgaaatcgcccacgcgctctgcctcaccgagcgccagattaagatctggttccagaaccgccgcatgaagtggaagaaagagcataaggacgaaggtccgactgccgccgcagctcccgagggcgccgtgccctctgccgccgccactgctgccgcggacaaggccgacgaggaggacgatgatgaagaagaggaagacgaggaggaatgaggggccgatccggggccctctctgcaccggacagtcggaaaagcgtctttaagagactcactggttttacttacaaaaatggaaaaaaaaaaaaaaaaagaaggaagggctggtcatggtggaggtgcgcaaggagaaacagttccagaaagtgatcacagaatacctgaatgcccaagagtcagcctggcgctcttggctgacctccaacattttaatctaagtggccgggacaaaattgaccaaaactagggggaggaggggaccagtagtactaatgacttactacaggtcattatgaaataagctaacaatactgaatctttggcgagaaaattttgctgctaagggcactgcactgtaatttgttagtaaaggctaatatagtagagattaaagctccgttgaggacaggtgccttgtctttaacacgttgtattcatcacatttaacataggagtaattgctgagggatgacttgattgtactacggtgagatgaagggttaagatttcttccccatcaccagtagcctccctagctggtgtccctgtctccatactctcctgaatccaccttccactattgtccgctggccctttccagcctgtaaactggacagttttcattcctctgcctaacatccagtcgtagcagcccatcccatctctttaaggataaaacccaaattcttggtatagtaaagctaaaccaagcgctctccctggaagggctcctgtgtttcaccaaagctgacttacgtactttccccatcttcccaggcatcttgtacgtcgttacatttatcatattggaaggtaataaatgatcttgttttcctcttttcctgggctccttattaagagcagggaacctaatttatatcctcagggcagaacaggtattcagaaaagaataatgcaagaggaaaaaagtttaatataaactagggagatcgtaacattggctaatcacgagcaaatatttatagaagacccactgtgtgctaaatggctcctaatatatacttaagatattctcccagcttggaaattctgctcacttcttgctcttgcttgcttctctggtgggcttccatccaaatttggccatgacatcagatcatatggttaatattaacaaatattgtataaattgttttcatacttaatatccaacaggttgtcaatttacgtactactggtgccttatctgtttttactgtcccatacactgcccatctggaataagcttagtgttaaaaa

SEQ ID NO: 149 - DNA, 2035 bp, Homo sapiens
gagtcgcacggagggcaaccgtcgacgggcttagcgcctcaactgtcgttggtgtatttttctggtgtcacttctgtgccttccttcaaaggttctccaaatgtcaactgtcaaggagcagctaattgagaagctaattgaggatgatgaaaactcccagtgtaaaattactattgttggaactggtgccgtaggcatggcttgtgctattagtatcttactgaaggatttggctgatgaacttgcccttgttgatgttgcattggacaaactgaagggagaaatgatggatcttcagcatggcagtcttttctttagtacttcaaagattacttctggaaaagattacagtgtatctgcaaactccagaatagttattgtcacagcaggtgcaaggcagcaggagggagaaactcgccttgccctggtccaacgtaatgtggctataatgaaatcaatcattcctgccatagtccattatagtcctgattgtaaaattcttgttgtttcaaatccagtggatattttgacatatatagtctggaagataagtggcttacctgtaactcgtgtaattggaagtggttgtaatctagactctgcccgtttccgttacctaattggagaaaagttgggtgtccaccccacaagctgccatggttggattattggagaacatggtgattctagtgtgcccttatggagtggggtgaatgttgctggtgttgctctgaagactctggaccctaaattaggaacggattcagataaggaacactggaaaaatatccataaacaagttattcaaagtgcctatgaaattatcaagctgaaggggtatacctcttgggctattggactgtctgtgatggatctggtaggatccattttgaaaaatcttaggagagtgcacccagtttccaccatggttaagggattatatggaataaaagaagaactctttctcagtatcccttgtgtcttggggcggaatggtgtctcagatgttgtgaaaattaacttgaattctgaggaggaggcccttttcaagaagagtgcagaaacactttggaatattcaaaaggatctaatattttaaattaaagccttctaatgttccactgtttggagaacagaagatagcaggctgtgtattttaaattttgaaagtattttcatttgatctttaaaaaataaaaacaaattggagacctgtgacataactctagtctctcaagattagaacgagcaaatggtaaagagattttcctctttaagaatcatttatagctctattctaatgatacccaatctgtacaggtgtaagttatacttctgaggtatgtcacatatgttagagtgccttcagatgtagtagaatatgtataatcactataatacagagctttgattcttttcacaaaccaagccctttttctagtattacaattttatcttgtactttcatccgttagagtaccagcatattcacttcattacattagcgtcatatgtttatgtataatcattataaatgtggccgggcactgcagcctgggtgaaagagtgaggctctgtctcaaaaaaaatcattataaatgcttatttttaagaccatatatatcaaaaagaaataaaaagctgagtgctgtggctcatggctgtaatcccagtgctttgggagggtgaggcaagaggatcacatgagtccaggagtttgagaccagccttggcaacatagcaacaccccatctctacaaaaataaagaaattagatgtggtggcctgcatctgtagtccagctacttgggagactgagaccagtagataacttgagcccaggagttcaaggctatgattgtgtcactgcactccagcctgggccacagaggaagactcagactcaaaagaagaagaagaacacagaagaaaagcagaaacaagaagaagatacagatgtaactttacgatgtaaaaaatctaaataagattgtattcaactctgcaagtattatactagtcatataaactcaaa

SEQ ID NO: 150 - DNA, 1318 bp, Homo sapiens
cgtgcgtgtctcgagtcgcacggagggcaaccgtcgacgggcttagcgcctcaactgtcgttggtgtatttttctggtgtcacttctgtgccttccttcaaaggtggtgctttgtccctgtgggtcatctgtactgattgcgccaagcaaagcatttgttctccaaatgtcaactgtcaaggagcagctaattgagaagctaattgaggatgatgaaaactcccagtgtaaaattactattgttggaactggtgccgtaggcatggcttgtgctattagtatcttactgaaggatttggctgatgaacttgcccttgttgatgttgcattggacaaactgaagggagaaatgatggatcttcagcatggcagtcttttctttagtacttcaaagattacttctggaaaagattacagtgtatctgcaaactccagaatagttattgtcacagcaggtgcaaggcagcaggagggagaaactcgccttgccctggtccaacgtaatgtggctataatgaaatcaatcattcctgccatagtccattatagtcctgattgtaaaattcttgttgtttcaaatccagtggatattttgacatatatagtctggaagataagtggcttacctgtaactcgtgtaattggaagtggttgtaatctagactctgcccgtttccgttacctaattggagaaaagttgggtgtccaccccacaagctgccatggttggattattggagaacatggtgattctagtgtgcccttatggagtggggtgaatgttgctggtgttgctctgaagactctggaccctaaattaggaacggattcagataaggaacactggaaaaatatccataaacaagttattcaaagtgcctatgaaattatcaagctgaaggggtatacctcttgggctattggactgtctgtgatggatctggtaggatccattttgaaaaatcttaggagagtgcacccagtttccaccatggttaagggattatatggaataaaagaagaactctttctcagtatcccttgtgtcttggggcggaatggtgtctcagatgttgtgaaaattaacttgaattctgaggaggaggcccttttcaagaagagtgcagaaacactttggaatattcaaaaggatctaatattttaaattaaagccttctaatgttccactgtttggagaacagaagatagcaggctgtgtattttaaattttgaaagtattttcatttgatctttaaaaaataaaaacaaattggagacctgtgaaaaaaaaaaaaaaaaaaaaaaaaaaaaaaaaaaa

SEQ ID NO: 151 - DNA, 2385 bp, Homo sapiens
agtggctcccgggctccctgccccgcacgacgcggcgggacttgggagccccgaaccctccaggggacgctgacctaggaggagcgcgtctcgcgccactcggcctggtggccgcgatgctgctggaaacggggctcgagcgcgaccgagcgaggcccggggccgccgccgtctgcaccttgggcgggactcgggagatcccgctgtgcgctggctgtgaccagcacatcctggaccgcttcatcctcaaggctctggaccgccactggcacagcaagtgtctcaagtgcagcgactgccacacgccactggccgagcgctgcttcagccgaggggagagcgtttactgcaaggacgactttttcaagcgcttcgggaccaagtgcgccgcgtgccagctgggcatcccgcccacgcaggtggtgcgccgcgcccaggacttcgtgtaccacctgcactgctttgcctgcgtcgtgtgcaagcggcagctggccacgggcgacgagttctacctcatggaggacagccggctcgtgtgcaaggcggactacgaaaccgccaagcagcgagaggccgaggccacggccaagcggccgcgcacgaccatcaccgccaagcagctggagacgctgaagagcgcttacaacacctcgcccaagccggcgcgccacgtgcgcgagcagctctcgtccgagacgggcctggacatgcgcgtggtgcaggtttggttccagaaccgccgggccaaggagaagaggctgaagaaggacgccggccggcagcgctgggggcagtatttccgcaacatgaagcgctcccgcggcggctccaagtcggacaaggacagcgttcaggaggggcaggacagcgacgctgaggtctccttccccgatgagccttccttggcggaaatgggcccggccaatggcctctacgggagcttgggggaacccacccaggccttgggccggccctcgggagccctgggcaacttctccctggagcatggaggcctggcaggcccagagcagtaccgagagctgcgtcccggcagcccctacggtgtccccccatcccccgccgccccgcagagcctccctggcccccagcccctcctctccagcctggtgtacccagacaccagcttgggccttgtgccctcgggagcccccggcgggcccccacccatgagggtgctggcagggaacggacccagttctgacctatccacggggagcagcgggggttaccccgacttccctgccagccccgcctcctggctggatgaggtagaccacgctcagttctgacccaggcccggctccaccctgcacctcacacgagggagctgcccctgggtgggcggctcggggctgctggggtttccgaggaagtggggccagggcgtcaagggagggctggtgccttcggagcctcccactgccgaccgcacagctccctctctgggggctgagggacccacctggcccctcctctgacacagggctggcccgccaggtggcctcccagcaagccagccttttttgtaagcaaatttctcccctttattgaccaattaactgagcacttgctgctatttctagacatgaaatgtcaccttgctgaggcccagcccagcccagcatagcccgagggctggaaaaacgctttcatctctaaaactgagaaatcatcataattgtgctttcacttcccaggctccatgtgtcttggagccgtcaccccgaggctccctctttaggtcggagattggccttgcctgtcgaggcaagaggctgcagaggcggggacacacctgtgtcctccgggagaggccccctcctctccccagaccacagggggcctctctgcctccagccccaccttccccgggagaagctttccccaatccccaggtctctagatcattctgttctcgagtatcctgtggaggaggcaaaaatgcctggcgccccttctctccaagctcaattctctaagcccctcagggtctcctcctcaccccaccccaggcccttggtgtccaggctgcacccacagatgtctgttgccaaacagcctgccctccctgccggagccggctctgccagccccagattgggaagtctccccgctggagaagggtggggctcctctgagcctgccctgcctcctccatcagatcctttgggaagaagtttctgggagatgcccgcagctgtgcgtgccccagacacaaaggctggcctgtgtgtaagtcaaagtcactcccgcaaacctgaatctcgagctacctattggttctgtgaatgttctgtgtcttttatttattctcgggtgatcagctctttccaagacttcaataaatttgtcagttacagtcaa

SEQ ID NO: 152 - DNA, 2434 bp, Homo sapiens
agggcggcccgcgggcgcagcgcccagcagcacccggagtcgcttggacgccggttcggggctattgcggggtggcgtcgctgggcccgggaaagttcgggactggagagtggcgacgccgggcggcgggacccatggaggcgcgcggggagctgggcccggcccgggagtcggcgggaggcgacctgctgctagcactgctggcgcggagggcggacctgcgccgagagatcccgctgtgcgctggctgtgaccagcacatcctggaccgcttcatcctcaaggctctggaccgccactggcacagcaagtgtctcaagtgcagcgactgccacacgccactggccgagcgctgcttcagccgaggggagagcgtttactgcaaggacgactttttcaagcgcttcgggaccaagtgcgccgcgtgccagctgggcatcccgcccacgcaggtggtgcgccgcgcccaggacttcgtgtaccacctgcactgctttgcctgcgtcgtgtgcaagcggcagctggccacgggcgacgagttctacctcatggaggacagccggctcgtgtgcaaggcggactacgaaaccgccaagcagcgagaggccgaggccacggccaagcggccgcgcacgaccatcaccgccaagcagctggagacgctgaagagcgcttacaacacctcgcccaagccggcgcgccacgtgcgcgagcagctctcgtccgagacgggcctggacatgcgcgtggtgcaggtttggttccagaaccgccgggccaaggagaagaggctgaagaaggacgccggccggcagcgctgggggcagtatttccgcaacatgaagcgctcccgcggcggctccaagtcggacaaggacagcgttcaggaggggcaggacagcgacgctgaggtctccttccccgatgagccttccttggcggaaatgggcccggccaatggcctctacgggagcttgggggaacccacccaggccttgggccggccctcgggagccctgggcaacttctccctggagcatggaggcctggcaggcccagagcagtaccgagagctgcgtcccggcagcccctacggtgtccccccatcccccgccgccccgcagagcctccctggcccccagcccctcctctccagcctggtgtacccagacaccagcttgggccttgtgccctcgggagcccccggcgggcccccacccatgagggtgctggcagggaacggacccagttctgacctatccacggggagcagcgggggttaccccgacttccctgccagccccgcctcctggctggatgaggtagaccacgctcagttctgacccaggcccggctccaccctgcacctcacacgagggagctgcccctgggtgggcggctcggggctgctggggtttccgaggaagtggggccagggcgtcaagggagggctggtgccttcggagcctcccactgccgaccgcacagctccctctctgggggctgagggacccacctggcccctcctctgacacagggctggcccgccaggtggcctcccagcaagccagccttttttgtaagcaaatttctcccctttattgaccaattaactgagcacttgctgctatttctagacatgaaatgtcaccttgctgaggcccagcccagcccagcatagcccgagggctggaaaaacgctttcatctctaaaactgagaaatcatcataattgtgctttcacttcccaggctccatgtgtcttggagccgtcaccccgaggctccctctttaggtcggagattggccttgcctgtcgaggcaagaggctgcagaggcggggacacacctgtgtcctccgggagaggccccctcctctccccagaccacagggggcctctctgcctccagccccaccttccccgggagaagctttccccaatccccaggtctctagatcattctgttctcgagtatcctgtggaggaggcaaaaatgcctggcgccccttctctccaagctcaattctctaagcccctcagggtctcctcctcaccccaccccaggcccttggtgtccaggctgcacccacagatgtctgttgccaaacagcctgccctccctgccggagccggctctgccagccccagattgggaagtctccccgctggagaagggtggggctcctctgagcctgccctgcctcctccatcagatcctttgggaagaagtttctgggagatgcccgcagctgtgcgtgccccagacacaaaggctggcctgtgtgtaagtcaaagtcactcccgcaaacctgaatctcgagctacctattggttctgtgaatgttctgtgtcttttatttattctcgggtgatcagctctttccaagacttcaataaatttgtcagttacagtcaaaaaaaaaaaaaaaaaa

SEQ ID NO: 153 - DNA, 2700 bp, Homo sapiens
actgggagatgggctggagccggcggggtccacagccagggaggcgggtgcaatatgtcagtaaatcccggtcccttcagcgggcactcctctcttccagagactttttctaagtgaagagggagtcctcagcccttgacacctggaaaacccgctcacagactcgaggctcccacagggcacccttggacctccccagtgtggttcctccagggggcctgcagtaccgaagtggggtgtggggggcagaagcagcgggaagccagacgtttgagtaactctgacggtgttgggggcacccacgcctgacacaaaggcagtggatcggcttgtccagtccactcataagtaattttgcggctgcccaatgatggggaaggcattgatatttaccccggaggcctgcagacagggccaccaggcagggcagccacatttgcgaggagtccctagaaagagtggccatgacgcttaacatgaaggagacccgatggggtgccccagctccagagatcccgctgtgcgctggctgtgaccagcacatcctggaccgcttcatcctcaaggctctggaccgccactggcacagcaagtgtctcaagtgcagcgactgccacacgccactggccgagcgctgcttcagccgaggggagagcgtttactgcaaggacgactttttcaagcgcttcgggaccaagtgcgccgcgtgccagctgggcatcccgcccacgcaggtggtgcgccgcgcccaggacttcgtgtaccacctgcactgctttgcctgcgtcgtgtgcaagcggcagctggccacgggcgacgagttctacctcatggaggacagccggctcgtgtgcaaggcggactacgaaaccgccaagcagcgagaggccgaggccacggccaagcggccgcgcacgaccatcaccgccaagcagctggagacgctgaagagcgcttacaacacctcgcccaagccggcgcgccacgtgcgcgagcagctctcgtccgagacgggcctggacatgcgcgtggtgcaggtttggttccagaaccgccgggccaaggagaagaggctgaagaaggacgccggccggcagcgctgggggcagtatttccgcaacatgaagcgctcccgcggcggctccaagtcggacaaggacagcgttcaggaggggcaggacagcgacgctgaggtctccttccccgatgagccttccttggcggaaatgggcccggccaatggcctctacgggagcttgggggaacccacccaggccttgggccggccctcgggagccctgggcaacttctccctggagcatggaggcctggcaggcccagagcagtaccgagagctgcgtcccggcagcccctacggtgtccccccatcccccgccgccccgcagagcctccctggcccccagcccctcctctccagcctggtgtacccagacaccagcttgggccttgtgccctcgggagcccccggcgggcccccacccatgagggtgctggcagggaacggacccagttctgacctatccacggggagcagcgggggttaccccgacttccctgccagccccgcctcctggctggatgaggtagaccacgctcagttctgacccaggcccggctccaccctgcacctcacacgagggagctgcccctgggtgggcggctcggggctgctggggtttccgaggaagtggggccagggcgtcaagggagggctggtgccttcggagcctcccactgccgaccgcacagctccctctctgggggctgagggacccacctggcccctcctctgacacagggctggcccgccaggtggcctcccagcaagccagccttttttgtaagcaaatttctcccctttattgaccaattaactgagcacttgctgctatttctagacatgaaatgtcaccttgctgaggcccagcccagcccagcatagcccgagggctggaaaaacgctttcatctctaaaactgagaaatcatcataattgtgctttcacttcccaggctccatgtgtcttggagccgtcaccccgaggctccctctttaggtcggagattggccttgcctgtcgaggcaagaggctgcagaggcggggacacacctgtgtcctccgggagaggccccctcctctccccagaccacagggggcctctctgcctccagccccaccttccccgggagaagctttccccaatccccaggtctctagatcattctgttctcgagtatcctgtggaggaggcaaaaatgcctggcgccccttctctccaagctcaattctctaagcccctcagggtctcctcctcaccccaccccaggcccttggtgtccaggctgcacccacagatgtctgttgccaaacagcctgccctccctgccggagccggctctgccagccccagattgggaagtctccccgctggagaagggtggggctcctctgagcctgccctgcctcctccatcagatcctttgggaagaagtttctgggagatgcccgcagctgtgcgtgccccagacacaaaggctggcctgtgtgtaagtcaaagtcactcccgcaaacctgaatctcgagctacctattggttctgtgaatgttctgtgtcttttatttattctcgggtgatcagctctttccaagacttcaataaatttgtcagttacagtcaa

SEQ ID NO: 154 - DNA, 2393 bp, Homo sapiens
agaggcaagaggctagcggctggaccacttgtgctggagtggtaaagaactatcatgaatccatttactgaaagtgtccatttctgaactcaccctaaagaggacaaacaccgcaaagtagttaaaagtcaggcattcgcgtcggacgtctgggtttgaattctgccctggcttgactggaaacgcttcccctatttcttccgtagcggaccgggagagcttactggcgctctgcgaaccggctggaaagaaacaccgagtcactcgtacagactcttggtcgcagaacttggctttccgctattggtcctccagaaccgcttgaaacaactggccccagctggcgcatcagaccgcagtgaggaatgccgcggggcgggtggcgaaggcagggtctgcccgccagtggattcccgggtgtcccgcgtggagcaggcttgcccagctgggaagcccatcaaacctcagtcttggcccacagtgggagagagaccagtgggtcccagacggaggccctcgcccgcttttggcgacctccactggcgtgaataaaagcacccctctcttaccctcagaaactgtgggtagcaaggtataaaacggagtctgggaccggtaagtcccaaggtgagcccgtatacagctctgccatctctgaggggttatgcagattctgagcaggtgtcaggggctcatgtcagaggagtgcgggcggactacagccctggcggccgggaggactcgcaaaggcgccggggaagagggactggtgagccccgagggagcgggggacgaggactcgtgctcctcctcggccccgctgtccccgtcgtcctcgccccggtccatggcctcgggctccggctgccctcctggcaagtgtgtgtgcaacagttgcggcctggagatcgtggacaaataccttctcaaggtgaatgacctatgctggcatgtccggtgtctctcctgcagtgtttgcagaacctccctaggaaggcacaccagctgttatattaaagacaaagacattttctgcaaacttgattatttcagaaggtatggaactcgctgctctcgatgtgggagacacatccattctactgactgggtccggagagccaaggggaatgtctatcacttggcatgctttgcctgcttttcctgcaaaaggcaactttccacaggagaggagtttgctttggtggaagagaaagtcctctgcagagtacattatgactgcatgctggataatttaaaaagagaagtagaaaatgggaatgggattagtgtggaaggtgccctcctcacagagcaagatgttaaccatccaaaaccagcaaaaagagctcggaccagctttacagcagatcagcttcaggttatgcaagcacaatttgctcaggacaacaacccagatgcacagacactccagaaattggcagaaaggacaggcttgagcagacgtgtgatacaggtgtggtttcagaattgtagagcacgccacaagaaacacgtcagtcctaatcactcatcctccaccccagtcacagcagtcccaccctccaggctgtctccacccatgttagaagaaatggcttattctgcctacgtgccccaagatggaacgatgttaactgcgctgcatagttatatggatgctcattcaccaacaactcttggactccagcccttgttaccccattcaatgacacaactgccaataagtcatacctaattcttttttcagggatagacttgattaaggatataaatttgtcatttattatgtataaaataccattgaaaagatattactgttaattttttatttaacacctaaagcatttccaacatcactttgctgcccaggtatgtatctatagttggcctgcaagacacttttattaattcttcattttttgtaaaacttatgtttacaagaagaaaacaaatcaaaacattttttgtattgtctggaaatagttcactctagtgtgtatctgttaatttatttgtcatcaaaagagcactttgcctaaaagaaaggactgacaagtgtgcaaaatgtttacaatcttttgtgaaattgtagtttatcattagtttgtatctgtaagttattgtaataaatattacctgtattttttgttatatacaactttatactttgaagcttgtatctgtgaatttgcaactgaaatttattttgccaatgttttctgaatgaactgaataaagcttctgttgtagcatgccatgcaaacacattattgtgtttgtggttgatgaattatggctgtaaataacactatagtttaataagcccaccattctgagtttattaaacattttccattcttgtgaaaatttcaaaaaaaaaaaaaaaaaaaaaa

SEQ ID NO: 155 - DNA, 7865 bp, Homo sapiens
agtccccaacccaatctacaggcactgggaacttgcaagcagccagggaacgctgaaaatagcacgtctttttctttctttgtgttcaaaactattttctttcttcaccagattttgttttcctccccccgctgcagttgtttcccattagtaactcgatctctcagagcagtaagattcgccttctacgcctctttttccctccgcccgaattgtttgttttctgcacatctccttcagggagccgctgaggcttccccccaactcttcccagttctttttgcttcccctcggccccccaagcagaccgatttccactccatctgtttcttctcctcctttctctccctctttccctccatcctcgagcgtctctgcgctcctacagggcagccctctctggtcccttgcctccttcactcggatgagctgaaagccccgggcgtgtgtatatggaaatagtggggtgccgagcagaagacaactcgtgtcctttccgccccccagccatgctctttcacgggatctccggaggccacatccaaggcatcatggaggagatggagcgcagatccaagactgaggcccgtctggccaaaggcgcccagctcaacggccgcgacgcgggcatgcccccgctcagcccggagaagcccgccctgtgcgccggctgcgggggcaagatctcggacaggtactatctgctggctgtggacaaacagtggcatctgagatgcctgaagtgctgtgaatgtaagctggccctcgagtccgagctcacctgctttgccaaggacggtagcatttactgcaaggaggattactacagaaggttctctgtgcagagatgtgcccgctgccaccttggcatttccgcctcggagatggtcatgcgcgcccgagactctgtctaccacctgagctgcttcacctgctccacttgcaacaagactctgaccacgggcgaccatttcggcatgaaggacagcctggtgtactgccgcgcccacttcgagaccctcttgcaaggagagtatccaccgcagctgagctacacggagctggcggccaagagcggcggcctggccctgccttacttcaacggtacgggcaccgtgcagaaagggcggccccggaagcggaagagcccagcgctgggagtggacatcgtcaattacaactcaggttgtaatgagaatgaggcagaccacttggaccgggaccagcagccttatccaccctcgcagaagaccaagcgcatgcgaacctctttcaagcatcaccagctccggaccatgaaatcctactttgccatcaaccacaacccggatgccaaggacctcaagcagcttgcccagaaaacaggtctgaccaaaagagttttgcaggtttggttccaaaacgcacgagccaaattcagaaggaaccttttgcggcaggagaatgggggtgttgataaagctgacggcacgtcgcttccggccccgccctcagcagacagcggagctctcactccacccggcactgcgaccactttaacagacctgaccaatcccactatcactgtagtgacatccgtgacctctaacatggacagccacgaatccggaagcccctcacaaactaccttaacaaaccttttctaacattggttttttttttttagtttttaaattcttcctcttctttttattattattctaattattattattttattatttacaagactttttttttcttctaacccacaagatatttggggaataaaaataacagcttggtgtgtagcatctgcagccacttggcaaatgagtttacagtattgtctcctttaagtgaatatattttgtctacaaagtgtatttggatttaaaaaaattaattaggtctttcagttggtaaggagagtttttgaataattctaataagtgcctcttaaaattgtatgttacttatttccagaatctcgaagaaaaaagaaaaaagagtggtattattatgggcaaataatcatattcccacttaaatgattaggttaataaagaaccagataattaattagttactttttaaatcttgcaattgtatgtgtgattatggagttttgaaaacgttacattttttaaatcttaaaactgaaaacttgtttttagtatttctatttcttacctgaactgttaattcaagtgaggaatatgatgaaataaaagcattaactacagacattttaaatagtaatgattaattaggtgagaaatctattacaggaatgtgacttttccttctcttaggggtgtacaactctaaaaactttttacttggttatttgtttttcaacatttgaaaaatacttaagctccctatgtatccatgaaaattccgcattgattttgacattccatacttttaacctcctaaagctaaaaacaatagctcggaaaccattctttctagttactttttttcccagggaaaatggaaataagcaaaatataatgttttaagaagtaaaaaaatcaatataatttaattaatagctctattaattggcttcagctgtaccatgatattgtatctggcattctatatgaataatgtttaaaatacccagcctggtagacttataccaacaattggttttgttttgttttattttattttgacataggttgacttatgtattgaaaataatttttctgatattagagatttgaagttattagtcttaaagtagataaactcagaagccttgtggatgctgatctgaatatatttcctagtttacagtagcatttttttcttttaatttaagctaaaatcttaatggtctgggcagtggtgaatgttcatctattacgcttctgttgtagttaaataccaattagattgtggatttcctaaaaaaataaaaaagaagtcaagatatatgtcttgctttagtggattgttaagaataactttgcacatattttccactttttggaccccttaaatctcctttggtggtcgaagtggctatttaatagattttaaaggtgtccttctggctgtataaatgtgtggttacatattgacagttcactgcccacattaaagtgcattattgtaacttttgctcagggtctttagaaaattagcacagaaagtagcttattttttaaaaaaagatgatggaagataagttaacactgtaacagaagaaaggtgtgattgccattatatatttagcaagtatggttatcatcttatatggagcttaaatcttgacttttcatacttctattacattttgggcatttaccactaaccagaccaaacaaccttggtaaggctgagatcttattaatacacttttacaggtaaaatattgacacttataaattttgttctttgacagaacaatatatggtactatatagatctactttattaagtagactaattataactcagttctcctatgtgccttatgatataacttggaagtaagtttgtgaaaaatcaggatatatgtgttgtttgttaaattaactgttttaagcccttttaacacctcactagttttgtactgttttacctcttatttctgaaactctttttatggtgtatcctgttagaggggacaaacatgtcatagaaagcagttgtgcactctttcaaatatagttgataaattcaataatcttatatattgagcttcgtgtttatagtacagtaagtggtctagcaaaattgtccatgtttctttgtttattgataaatgcattgtatagaaactatttcccctaaatatttatggaccaaacaattgtgatatatcctattaaatttgtgtgaataaaacattttgaatctaaggagttttctttcccatcagttttatttaagttttaaccgtactagtgtgttccagcatctatatgtaaaagcttttcaaatggtaatacaacattgttagaaatatttaaacatacaaatagtttttagacttccaaacttctgattcatatgaaatgttacacattgttgcacaggcagtgtaattcaacctagaaatacctttgaatatatttgcttataacaaaagtaatgccccactgatttgactcagtccaatttttagaataaaaaggctaattagcatataaagtaattgcatggaacgaaaccttaaatatgattaagatttcatgttaggtctattgagcacaaatggatatttgtaaatctaaatagaaattgcagacccctaaaagccaagttgctctgtagttaataaattgtcactatgatttttttcagggagaacaaatcttggggcattacagccaaacatcccgacgtttgaaaattccctaaagtattaaaagaaggggaaaagtttgatcggaaatccactgcagtgaagacaaagacactattaggttatgataatcatacattaaaaaatttattaagccaaaaaaaaagagagagagagagacttaaatgtcatttactgaatgttaacgaaacttgtgttctttatggtgtctaacacaactgaaggcctaaaattatgtggtttaaacaaaattagataaaccatgtacaaaaccagagcaacctggcagtaatatgcccaccccatatttgaaaaaaattattattgaaaaaaatttcacacatttgtcaagcacagttgtaaaataaagtccaaaacattcatttcacctgcttgctaatgtgtattagtcctgttaatggcattttccaactgtaaattcaaagaaaagctatcacccatttaagagtatagggatcaaaccccagtaattttagcattattgtttatcacttcctttttaaacagaaatctctgcatgcacttttacatatgtcacctctagtgtacacctctgtatgatgacttatctttgctgtttcttgtatgataaatagctttcattaataaacatttatttgatgcaaacatagttaactttatgttaaacacatgctgttgaaattaattttgaacacttaaagaggcagcacagtacatttacaacttgttatactaatgaaaaaatacaaacagcatagtgagattaaattctggtaatctaggataaaattacttacttggtttttaccttttcatgacttattttcatttgttgtattcaattgccacatgtattaaaaataaaaaacaaagtgaacccaaattacaacaaaataaaccttagaataaactattgtgtaaaatttcagcaacttttttagattactagggtaaaatttatagatcctatgtgagtttacatgtttgctatgcaatgaacaaatttattgatgtatacaaatatattctgaactataaaaagatccaatctttgcatagttcaattacatatgattattacaaacaaaaaagcaaatggaaagacagacaaatatttaggaatgaggttttttttaattgttaaagggaatatttgaagaataaaattttagctattcctatttagccgtatatccaaagcatatgttaaacaaactaacatatactttccagaaaatttttcattatgatgaaatttttattatatacaaatgaaccctatgtaaatgatgtaacttttatgaatgacagacattaaatatttcacttacatgtattctcagaattttgaatgttttcttaaatgctttcacttcctgaataataaaaagaaaaaattttaaagaagagagagcaacttactaataaaaaaaagcaatgcaccatgacaagtagactattttgagtgatcacaaatcatgctggttttgtcagtaacttgaatgtttatgcctcattgaaacctcatccacagctatagcaacttaaatagattttccaatgcatttccagccagtttattcaaatctttgccctacagtcttgccttctttccctgttctgtcacctgtggcaatttcatttagaagtattttggaacttcgcctggttttacagacctttaaatatttgtctggtatgtgaaatgcaggaagagaccagagagggaaagaacataactgaaattagacatctgaaaaaaaaatacaaatttgaaacaggcacattttttaaaaccaaaaaaaaaaaaaaaaagagagagagagagaaaggagtactaattatgtgagtgggaagaggaagcgtgtgatgcagagctggaaggtctgttgtgctttactgtgatgtaaagcagtctttgagtctgggcaactgcacatttactgtttggtgtggaatagaaaaatgtggacctcttagttgagagcaggacactaaattttcatagcttctacctcccagttgcctgggttagtctaacttctggcagattgatcttgggcaaaaagcttcactgagagttagtgtctgtgtgctttggttgaatagccaccttaatactgacttacatagtgggtaggtttttgatacctcaaataaggataaaactccataataaaggacccaaagcaaatacttttaaaacttaggtgatttttcatcacctaaaacataaatagctttatttagcaaaatcccagtggaatctaccacacattcttttataataacccttttttgggagtcaaagtattgtttttttattagccacatataaatatcatctcattttctgttgcagtgtgactgcaaggcatgttgtggtggaaatcattagaactgggaagctctggaatggaaatttggaatcgtgtcattctaggctcttaaagagaatattagggataatactgttgtaaaaaataaatataaacacctaattttgtatgaagttttgctatttaaattttaactatgttataaacaaagctagctttacttgtagagagttcgtgtactcttgagctcattcaatagcttttacattttgtagtctcttccacaacagggcaaaataagcacagtaggacttagtccaaattgacgaaatatcattgaattttctttgaaagcatatatatagataaactctggattggtcttttagatctgttttctgtttttagtaattgggaacaaactcttgatattaaaataaataaaatgcctctaatgtaaagccacagccctgcttctagccaatgtcaaaaataggaagtttttttaatggtttactgttgattttaaacattttaataatagtgctctgccctcacaacagtttttttttcagaataatattatgatttaccttattttaaaaataaattataattctaacttaaaatattattttaaatgcccctctgggaagatttccgttttattttatgaggttccctggcagttgggggggtggtgaggttgggagagggaaagtttagaactgtgcatgatactcaaggaaaagtctatgaatatgatgtaagtagtaacattattgccacaactaaatttctgtttaactgtgttgcagaatatgataatgtcatctaacatcactccctacttgcaacattcctctgtgaatattaatatagttaaccctcccttattatgtatcatatcaataagtttctcttcccttggattaatttttgcttctttgcattacattttatcttgtgctaagataacaaaaagcaagcaagaataaagatccagatattagccatatgtagaaagttcctggtgtgcatttctgtgtacttttccctcacatattagaattgtcaggaaagtttttttcttttggaactttctgtttacattttgcatgatcttataaattaacctgaagagtaattggataccttttatggttatttgaaaataaaatttgctacaaataaga

SEQ ID NO: 156 - DNA, 2078 bp, Homo sapiens
gcgtgatccactccttttcctctaagaatgctgaacggtaccactctagaggcagccatgctctttcacgggatctccggaggccacatccaaggcatcatggaggagatggagcgcagatccaagactgaggcccgtctggccaaaggcgcccagctcaacggccgcgacgcgggcatgcccccgctcagcccggagaagcccgccctgtgcgccggctgcgggggcaagatctcggacaggtactatctgctggctgtggacaaacagtggcatctgagatgcctgaagtgctgtgaatgtaagctggccctcgagtccgagctcacctgctttgccaaggacggtagcatttactgcaaggaggattactacagaaggttctctgtgcagagatgtgcccgctgccaccttggcatttccgcctcggagatggtcatgcgcgcccgagactctgtctaccacctgagctgcttcacctgctccacttgcaacaagactctgaccacgggcgaccatttcggcatgaaggacagcctggtgtactgccgcgcccacttcgagaccctcttgcaaggagagtatccaccgcagctgagctacacggagctggcggccaagagcggcggcctggccctgccttacttcaacggtacgggcaccgtgcagaaagggcggccccggaagcggaagagcccagcgctgggagtggacatcgtcaattacaactcaggttgtaatgagaatgaggcagaccacttggaccgggaccagcagccttatccaccctcgcagaagaccaagcgcatgcgaacctctttcaagcatcaccagctccggaccatgaaatcctactttgccatcaaccacaacccggatgccaaggacctcaagcagcttgcccagaaaacaggtctgaccaaaagagttttgcaggtttggttccaaaacgcacgagccaaattcagaaggaaccttttgcggcaggagaatgggggtgttgataaagctgacggcacgtcgcttccggccccgccctcagcagacagcggagctctcactccacccggcactgcgaccactttaacagacctgaccaatcccactatcactgtagtgacatccgtgacctctaacatggacagccacgaatccggaagcccctcacaaactaccttaacaaaccttttctaacattggttttttttttttagtttttaaattcttcctcttctttttattattattctaattattattattttattatttacaagactttttttttcttctaacccacaagatatttggggaataaaaataacagcttggtgtgtagcatctgcagccacttggcaaatgagtttacagtattgtctcctttaagtgaatatattttgtctacaaagtgtatttggatttaaaaaaattaattaggtctttcagttggtaaggagagtttttgaataattctaataagtgcctcttaaaattgtatgttacttatttccagaatctcgaagaaaaaagaaaaaagagtggtattattatgggcaaataatcatattcccacttaaatgattaggttaataaagaaccagataattaattagttactttttaaatcttgcaattgtatgtgtgattatggagttttgaaaacgttacattttttaaatcttaaaactgaaaacttgtttttagtatttctatttcttacctgaactgttaattcaagtgaggaatatgatgaaataaaagcattaactacagacattttaaatagtaatgattaattaggtgagaaatctattacaggaatgtgacttttccttctcttaggggtgtacaactctaaaaactttttacttggttatttgtttttcaacatttgaaaaatacttaagctccctatgtatccatgaaaattccgcattgattttgacattccatacttttaacctcctaaagctaaaaacaatagctcggaaaccattctttctagttactttttttcccagggaaaatggaaataagcaaaatataatgttttaagaagtaaaaaaatcaatataatt

SEQ ID NO: 157 - DNA, 65 bp, Mus musculus
agggattggagagaaaggcagttcctgatggtcccctcccaggggctggctttcctctggtcctt

SEQ ID NO: 158 - DNA, 91 bp, Mus musculus
gggcagcgcgccggcaccttggctctagactgcttactgcccgggccgccttcagtaacagtctccagtcacggccaccgacgcctggccc

SEQ ID NO: 159 - DNA, 95 bp, Mus musculus
ctcatctgtctgttgggctgggggcagggcctttgtgaaggcgggttatgctcagatcgcctctgggcccttcctccagtcccgaggcagattta

SEQ ID NO: 160 - DNA, 98 bp, Mus musculus
gaccctttggcgatctctgcctctctgggcctgtgtcttaggctcttcaagatccaacgagcaaagcacagggcctgcagagaggtagcgctctgctc

SEQ ID NO: 161 - DNA, 99 bp, Mus musculus
catggcacctccgtttccctgaggagccctttgagcctggagtgaaaaaaaaaaacaggtcaagaggcgcctgggaactggagaagagtgttaaacttc

SEQ ID NO: 162 - DNA, 86 bp, Mus musculus
aattgacttagctgggaagtggggaacccttccatgaggagtagaacactccttatgcaagattcccttctacctgactgagttga

SEQ ID NO: 163 - DNA, 96 bp, Mus musculus
tgatattatgccatgacattgtgtcaatatgcgatgatgtgttgtgatggcacagcgtcatcacgtggtgacgcaacatcatgacgtaagacatca

SEQ ID NO: 164 - DNA, 92 bp, Mus musculus
tcgggaggggcgggaggggggtccccggtgctcggatctcgagggtgcttattgttcggtccgagcctgggtctccctcttccccccatccc

SEQ ID NO: 165 - DNA, 77 bp, Mus musculus
cagcagtaccaggagagagttagcgcattagtgcaatagttagtcctgatttctgggtttttctaatggctgctctt

SEQ ID NO: 166 - DNA, 1041 bp, Homo sapiens
atgccctcgcccctggccctacgcccctacctccggagcgagttttccccatcggtggacgcgcggccctgcagcagtccctcagagctacctgcgaagctgcttctgggggccactcttcctcgggccccgcggctgccgcgccggctggcctggtgctccattgactgggagcaggtgtgcttgctgcagaggctgggagctggagggtttggctcggtgtacaaggcgacttaccgcggtgttcctgtggccataaagcaagtgaacaagtgcaccaagaaccgactagcatctcggcggagtttctgggctgagctcaacgtagcaaggctgcgccacgataacatcgtgcgcgtggtggctgccagcacgcgcacgcccgcagggtccaatagcctagggaccatcatcatggagttcggtggcaacgtcactttacaccaagtcatctatggcgccgccggccaccctgagggggacgcaggggagcctcactgccgcactggaggacagttaagtttgggaaagtgtctcaagtactcactagatgttgtgaacggcctgctcttcctccactcgcaaagcattgtgcacttggacctgaagcccgcgaacatcttgatcagtgagcaggatgtctgtaaaattagtgacttcggttgctctgagaagttggaagatctgctgtgcttccagacaccctcttaccctctaggaggcacatacacccaccgcgccccggagctcctgaaaggagagggcgtgacgcctaaagccgacatttattcctttgccatcactctctggcaaatgactaccaagcaggcgccgtattcgggggagcggcagcacatactgtacgcggtggtggcctacgacctgcgcccgtccctctccgctgccgtcttcgaggactcgctccccgggcagcgccttggggacgtcatccagcgctgctggagacccagcgcggcgcagaggccgagcgcgcggctgcttttggtggatctcacctctttgaaagctgaactcggctga

SEQ ID NO: 167 - DNA, 2076 bp, Homo sapiens
atggctctccttttgacactaacatcaccagacctggagggtacctgggacaccagagacaaggatggcttcaaagcccaggaggggccgcccctggctgtacctgaatttcctgtgtgtggactgtaccggatctacggagtctgtggctctttcagctccttcttcatcatccggtgcagcctttgtgctctggagaccctcaaatcaccccaacatgatcccttagagatacctgaacagtccctcaaactcatacccctggtgtctgggaaaagggaactcacaaggggccagaaagctggagagaagcccctggctgcaggacccggggaggaggaactgctccggggctcagcccctcatgctcaggacactcagagtgaggaactgccaccctcctgcaccatctcaggagagaagaagccgccagcagtctctggagaagccaccggggctgatgctgggagactgtgcccgcccccccgctccagggctccccacaaagacagaactctagcccgctccaggccccagactcagggggaagattgttccctcccagtgggagaggtgaagataggaaagaggtcctattctccagcccccgggaagcagaaaaagcctaatgccatgggtctggccccaacatcatctccgggtgcccctaactcagcccgtgccacacacaacccagtgccctgtgggtcaggccgggggccctgccacctggccaatctcctcagtacattggcgcagagcaaccaaaacagagaccacaagcaggggcccccggaagtgacctgccaaattaggaaaaagacacgaaccctataccgctcagatcagctggaggagctagagaagatattccaagaagaccactatcctgacagtgataaacgccgagagattgcccagacggtgggggtgaccccccagcgcatcatggtaaagggggccggctcactggtggcagggtggagtggcggagggcccaccattgaaacactcgaattgcagagtgagcgctcagcggtagcctgggtgtggttccagaatcgccgggccaagtggcgaaaaatggagaaactgaatgggaaagaaagcaaggacaatcctgcagcccctggccctgccagcagtcaatgcagctctgcagctgagatcctacctgctgtgcccatggagccaaagcctgaccctttccctcaggagtcccctctggatacctttccagagccccccatgctgctgacttctgaccagactttggcccccacccaacccagtgagggtgctcagagggtggtgacccccccactcttcagccccccacctgtgcgaagggccgatcttcctttcccccttggccctgtccacaccccccaactgatgccactgctgatggatgttgctggcagtgacagcagccacaaggacggcccctgtgggtcctgggggacaagcatcaccctgccacccccctgttcatatttggaggagctggagccccaggattaccaacagagcaaccagccaggacccttccagttctcccaggctccacagcccccgcttttccagtcccctcagcccaagttgccctacctccccactttccccttctccatgcccagttcactgacgcttccaccgcccgaagactctctctttatgtttccctgtggccccagcgggggcacatcgcagggctattgcccaggtgcctcctcaggacagatcctgatgcaaccacctgctgggaatataggtacagcctcctggagtgacccctgtttgccagagctgcccttccctggtccgttctgcccacaagctctggggcatcccccaggaggggatggctactttcctgatctatttccaactccctgcccccaggctctgggcaggcagccttcgtcagctctctcatggatgcctgaaggggccagaccagggactgggcccttactcagcaaggcaaaagaggaaccaccagctgcttccctggatcagccctcagcactggaggaggccagaggggatgacaagaatagccatgtcccctag

SEQ ID NO: 168 - DNA, 2610 bp, Homo sapiens
tcctccgtgcaaaggaagctgctcccagcttctaacccacactactgatcttgccctcaattgacatcaagcaaaggagatatttaaagacaagctcgagtatcttcaattttacagatctagaattgtcaccataaagttagtgagcttaaagtgtgttgccccaaaaggatagaggaacctgctggccatgacatggctctccttttgacactaacatcaccagacctggagggtacctgggacaccagagacaaggatggcttcaaagcccaggaggggccgcccctggctgtacctgaatttcctgtgtgtggactgtaccggatctacggagtctgtggctctttcagctccttcttcatcatccggtgcagcctttgtgctctggagaccctcaaatcaccccaacatgatcccttagagatacctgaacagtccctcaaactcatacccctggtgtctgggaaaagggaactcacaaggggccagaaagctggagagaagcccctggctgcaggacccggggaggaggaactgctccggggctcagcccctcatgctcaggacactcagagtgaggaactgccaccctcctgcaccatctcaggagagaagaagccgccagcagtctctggagaagccaccggggctgatgctgggagactgtgcccgcccccccgctccagggctccccacaaagacagaactctagcccgctccaggccccagactcagggggaagattgttccctcccagtgggagaggtgaagataggaaagaggtcctattctccagcccccgggaagcagaaaaagcctaatgccatgggtctggccccaacatcatctccgggtgcccctaactcagcccgtgccacacacaacccagtgccctgtgggtcaggccgggggccctgccacctggccaatctcctcagtacattggcgcagagcaaccaaaacagagaccacaagcaggggcccccggaagtgacctgccaaattaggaaaaagacacgaaccctataccgctcagatcagctggaggagctagagaagatattccaagaagaccactatcctgacagtgataaacgccgagagattgcccagacggtgggggtgaccccccagcgcatcatggtgtggttccagaatcgccgggccaagtggcgaaaaatggagaaactgaatgggaaagaaagcaaggacaatcctgcagcccctggccctgccagcagtcaatgcagctctgcagctgagatcctacctgctgtgcccatggagccaaagcctgaccctttccctcaggagtcccctctggatacctttccagagccccccatgctgctgacttctgaccagactttggcccccacccaacccagtgagggtgctcagagggtggtgacccccccactcttcagccccccacctgtgcgaagggccgatcttcctttcccccttggccctgtccacaccccccaactgatgccactgctgatggatgttgctggcagtgacagcagccacaaggacggcccctgtgggtcctgggggacaagcatcaccctgccacccccctgttcatatttggaggagctggagccccaggattaccaacagagcaaccagccaggacccttccagttctcccaggctccacagcccccgcttttccagtcccctcagcccaagttgccctacctccccactttccccttctccatgcccagttcactgacgcttccaccgcccgaagactctctctttatgtttccctgtggccccagcgggggcacatcgcagggctattgcccaggtgcctcctcaggacagatcctgatgcaaccacctgctgggaatataggtacagcctcctggagtgacccctgtttgccagagctgcccttccctggtccgttctgcccacaagctctggggcatcccccaggaggggatggctactttcctgatctatttccaactccctgcccccaggctctgggcaggcagccttcgtcagctctctcatggatgcctgaaggggccagaccagggactgggcccttactcagcaaggcaaaagaggaaccaccagctgcttccctggatcagccctcagcactggaggaggccagaggggatgacaagaatagccatgtcccctagttggggggtcaaagagtgaaaagaggctgcttgggtgggataggattgggctcgctgagaggacaggggttgggggtttgggaaagagtgtggactctgtagactgaggggagagttagacgtttcccctgtgtaggctcgtcttgttgatatgagaaggaagaaagagggctggcgcttcccttttcttcacactctgtgtgggggtcctgaaggaagcaggtggcctgtgttacttctgaatgttgtatcaggtgtttttgtttgtttcctatccttgcttgacaaatgagctggagtgtccaccgtaagcagtaaactagtccgtcctgcggttttctctgtggttatgtgtctccattatgtgtctccacactcacactaatgaagagctccattttcgtccttttattccacttggctgagcagtcattg

SEQ ID NO: 169 - DNA, 5900 bp, Homo sapiens
gctgtcgctgtgtttgctttaacctgagtcttgttccttattgtggttcctgctgtggttttgatcatgttgttaccctcggacgtagcccggcttgtattgggttacttacagcaagaaaacctcatttctacctgccagacttttattttggaaagttcagatttaaaagaatatgcagaacattgtacagatgaagggtttattccagcctgcttactgtccttatttggaaaaaacttgacaacaattttaaatgagtatgtagctatgaaaacaaaagaaacatcaaataatgtcccagcaataatgtcatctctatggaagaaattggaccatacactttctcagatcaggagcatgcaaagttccccaaggtttgctggcagtcagagagcccgaacgagaactggaattgcagaaatcaaacggcagagaaagcttgcatctcaaacagctccagccagtgcagagttgctcactttaccttacctttcaggacagtttaccactcctccttccacaggtacacaggttactcgaccaagtggccaaatttcagatccatcgaggtcatattttgtagtggtcaaccactcacagtcacaagatactgtaaccactggagaagctttaaatgtcattcctggtgctcaggaaaagaaagcacatgccagtttaatgtctcccggtagacgcaaaagtgaatctcagagaaaaagtaccactttgtctggccctcattcaacaatacggaatttccaagatccaaacgcttttgcagtagaaaaacaaatggttattgaaaatgcacgagaaaaaatactaagcaacaaatctcttcaagaaaagctagcagaaaacataaataaatttttaactagtgataacaatattgcccaagtacctaagcaaacagataacaaccctacggagccagagacttcaattgatgaattcctaggacttccgagtgaaattcacatgtctgaagaagctatacaggacatattggaacagacagaatcagacccagcatttcaggcactctttgatctctttgactatggcaaaacaaagaataataaaaatatatcacaaagtatttccagtcaacctatggaatccaatcccagtatagtcttagcagatgaaactaatctagcagttaaaggttcttttgaaacagaagaatctgatggtcagtctggtcagcccgctttttgtacatcctatcagaatgatgacccattaaatgctttgaagaatagcaacaaccatgatgtgcttagacaagaagaccaggaaaatttttcccaaataagtaccagcatacagaaaaaggcctttaaaacagctgtacccactgaacagaagtgtgacattgacattacctttgagtccgtgcctaatttgaatgactttaaccaaagagggaattctaatgctgaatgtaatccacattgtgctgaattatacaccaatcagatgtccactgaaactgaaatggctatagggattgaaaagaactctttgtcttcaaatgtaccgagtgaatctcagttacagcctgatcagcctgatataccaataacttcatttgtttcacttggttgtgaagctaacaatgaaaacttaattctctctgggaagagttctcaacttttatcccaagatacttcattaactggaaagccatctaaaaaaagtcaattttgtgaaaattctaatgatacagtaaaacttaaaattaattttcatggttccaagtcatcagattctagtgaaattcacaagagtaaaatagaaattaatgtgttagaaccagttatgtcacagctatcaaattgccaagataattcttgtcttcaaagtgaaatactacctgtgtctgttgaaagttcacatttaaatgtatctggacaagtagaaattcatcttggagattcgctgtcttctactaaacaaccatctaatgattcagcatctgttgagttaaatcatacagaaaatgaagctcaggcatccaagtctgagaattcacaggagccttcatcttctgtaaaagaagagaatactatttttctctctttaggtggaaatgctaactgtgagaaagttgcactgacgcctccagaaggcactcctgtagaaaacagtcactctcttcctccagaatctgtgtgttcttcagtgggagattctcaccctgagtcccaaaatactgatgataaaccttctagcaacaactcagcagagatagatgcatcaaatatcgtctctctcaaagttatcattagtgatgatccatttgtttcctcagatactgaacttaccagtgctgtttctagtattaatggagaaaacctgccaactataatcttgtcttctcctactaaatcacctactaaaaatgcagaactagttaaatgcctatcttcagaagaaactgtaggtgctgttgtatatgccgaagtaggggattcagcctcaatggaacagagtcttttaacattcaaatctgaagactctgcagtaaacaatactcagaatgaagatggcattgctttttcagctaatgttacaccatgtgtttccaaggatggaggatatatacagttgatgccagccacaagcacagcttttggcaattcaaataacattctgatagctacctgtgtgactgatccaacagcgttaggaacatctgtaagtcagtctaatgtagtggtgttgcctggaaattctgcacctatgactgctcaacctctaccacctcagttacagacaccaccaaggtcaaacagtgtatttgctgtcaaccaagctgtgtcaccaaacttttcacaaggatctgccataataattgcctctccagtccagcctgtactccaaggaatggtagggatgatcccagtatctgtggttggacagaatggaaataacttttctactcctcctcggcaggttcttcatatgcctttgacagcacctgtatgcaatagaagtatccctcaattccccgtccctccaaaatctcagaaggctcagggactaagaaacaagccttgtataggaaaacaagtaaataatttggtggattcgtcaggtcattcagttggatgtcatgcacaaaaaactgaagtttctgacaaaagtattgccacagatcttgggaaaaaatcagaagaaaccacagttcccttcccagaagagagtatagttccagctgctaaaccatgccacagacgtgtactctgtttcgacagcactactgctcctgtggcaaatacgcaggggccaaaccataagatggtgtcccaaaacaaagaaaggaatgcagtctcttttcctaatcttgactcacccaatgtgtcctccaccttaaaacccccttctaataatgctatcaaaagagagaaagagaagcctcctctgcctaagattttatctaaatcggaaagtgccattagccggcataccaccataagagaaactcaatcagaaaagaaagtttcaccaacagaaattgtgcttgaatctttccataaagcaacagctaataaggagaatgaattatgcagcgatgtagaaagacagaaaaatccagaaaattcaaaactatctattgggcagcaaaatgggggtttgcgaagtgagaaatctatagcttcactgcaagaaatgaccaaaaaacaaggcacatcttcaaacaataaaaatgtactttcagtaggtacagctgtgaaggatctaaaacaagaacaaactaaatccgccagttctttgattaccacagaaatgttacaggatatacagaggcacagctcagtaagtaggcttgctgatagtagtgatttacctgtgccccggacacctggctcaggggcaggggaaaaacataaagaagaacctatagatattatcaaggccccctctagtaggcgtttcagtgaagacagtagtacatcaaaagtaatggtccctcctgtcaccccagacttgcctgcctgcagccctgccagtgaaacaggaagtgaaaacagtgtaaatatggctgcccacacattaatgattctctccagggcagccatttctaggactacttcagcaactcctctgaaagataacacacaacagtttagagcatcttcaaggagcaccacaaaaaagcggaaaattgaggaattagatgaacgtgagcgaaactctcgtccttctagtaaaaatcttacaaattcatcaataccaatgaaaaagaagaaaattaagaaaaagaagcttcccagttcatttccagcaggaatggatgtagacaaatttttgttatcattgcattatgatgagtaaacattctggacacataagacagtaggtgttaaaaactcatatcccttaaactgagtgtagggaatgggatattgacagaatctgaaagcatgacctgcactttcattgtactgaaacttcactttatatctaaatcatgctgtttctgaaacagcttcctagtttgtaaatagacttacttggtatatttttattttgggaaaaacgtttgcagaaatgtaagtaaagccaatctgcaaaactgtatagctttgacaattccatattgtaaatactgtgtaaatcttgttgaaatagaggttaaatcaacctaatgttcttacactgtgttttttgacttcttatgatccctaattctcgagacttactcatctggaatagtttctcacttgttttggaggaaaatgatgcttattcttataaattaccttcagtaactattcaataagacatttaaatacacaatcactaagtactacaaaataataaccacctcaactgatagcaaaatatctaattagaaatcaacagtttgatgagtttttttcctagagtgaattactacccctttcttataattgctgtaagtattatatttctggaatttcacactttacctactctgatcactctgttctctttgttttaaagagagaattttgtaaaccatttattgaatgttctgatctttcatttataacttaagattttttaacagaactttaagtggttagactattgagccataaaattttggtttgtagtagagatttctcggtatgtacttttcccctaaatgctggggatttaaagaattgcactaattcatagaactctttacattgtagtgaccaatgcacatataatttaaatcttgtgttctatgtgagagtttatgtggaggattatcttctggtgttgtgtccatcataagatgtaaaaagagaaatcatagttttatattttagtttctcctacaatgggtatgttaaataactatatctatacttagatatagtgcattgtctgtgtcccttaaagtgttacaaagagtttctctcaaaaggtccttaaggagagtgagagatgagagaggtgccttctctgtattagactcacacacatcagtccagttgaagaattggtttaaacttttaaatgagacagaaattataattagtacctgaccaattgtgcctagatattaaagtatgttctctttagtactttccgttcaattaaatatcagtatattagggatttttttctacaggtgtatattttgttgaagagtcactttcctcaaccatttttttgtactgggcctttaaaaaaataaatccatccaactttaacacaacatttctcagtgtagaaatcatgtcttcttaattgctgaaccttactgcaaaaacttgtgatgtaagaaatttgtatggtgtggcagtggtctattcctaaggaactaaatatcatatagttaatgtttatttaactcagcttgagactgtactacagttaggtttgaataaatattttcattaacttca

SEQ ID NO: 170 - DNA, 901 bp, Homo sapiens
gttgcctaaacctctgccacccacctgtgaacttcactttgccacagggaggcactgaactgaaaaactgccttgtaagaggtgtcgcccctctgtctactccctttcttatatcaagaggggaaaaacacgtaactacctctacccgatctggtcaccatacgcctattacctttactgttacaagtaccggatcactctccgggagaagatgctgcctcgttgttataaaagcatcacttataaggaagaggaggacttgacactccagccccgttcctgcctccagtgctcctgagtccctagtaggcctccaggagggcaaaagcaccgagcagggtaaccacgaccagcttaaagaactgtattcggctgggaacttgacggtgctggctactgaccccctgctccaccaggacccagtacagttagactttcacttccgccttacctcccagacctctgcccattggcacggccttctctgtgaccgtcgactcttcctggatatcccatatcaggccttggatcaaggcaaccgggaaagtttgactgcaaccctggagtacgtggaagagaagacaaatgtggactctgtgtttgtgaacttccagaatgatcggaacgacagaggtgccctgctgcgggccttcagctacatgggctttgaggtggtcagaccagatcaccctgccctccctcccttggacaatgtcatctttatggtgtatccccttgaaagggatgttggccacctgcccagtgagcctccttgaacatgcttattccaacgctttgaggggctggaagccttgacacatggaatcaggggcccgggatgtgattcaggacactttccatcctaggaataaagggtagtgcaatcaaaaaaaaaaaaaaa

SEQ ID NO: 171 - DNA, 866 bp, Homo sapiens
gcgcctcggcccgggccttactctccaccgactgcgtcaggatgagctccaggttttctttgggccgatgcttcgtgtcctccaccagcttatagacgcgatgtcgccggtgcaggcgcggcttccggccctccccggccagcggtaccttccaccagcgctccacgatgaccgtgccctggcggccaggaaagcgacgcatcacttataaggaagaggaggacttgacactccagccccgttcctgcctccagtgctcctgagtccctagtaggcctccaggagggcaaaagcaccgagcagggtaaccacgaccagcttaaagaactgtattcggctgggaacttgacggtgctggctactgaccccctgctccaccaggacccagtacagttagactttcacttccgccttacctcccagacctctgcccattggcacggccttctctgtgaccgtcgactcttcctggatatcccatatcaggccttggatcaaggcaaccgggaaagtttgactgcaaccctggagtacgtggaagagaagacaaatgtggactctgtgtttgtgaacttccagaatgatcggaacgacagaggtgccctgctgcgggccttcagctacatgggctttgaggtggtcagaccagatcaccctgccctccctcccttggacaatgtcatctttatggtgtatccccttgaaagggatgttggccacctgcccagtgagcctccttgaacatgcttattccaacgctttgaggggctggaagccttgacacatggaatcaggggcccgggatgtgattcaggacactttccatcctaggaataaagggtagtgcaatcaaaaaaaaaaaaaaa

SEQ ID NO: 172 - DNA, 753 bp, Homo sapiens
gttcacaggcacagaatgagacctgagggaggaccccggcgtcggcggcaggaaaggcccccgccagtgctgcctgcggcgcgccgcatcacttataaggaagaggaggacttgacactccagccccgttcctgcctccagtgctcctgagtccctagtaggcctccaggagggcaaaagcaccgagcagggtaaccacgaccagcttaaagaactgtattcggctgggaacttgacggtgctggctactgaccccctgctccaccaggacccagtacagttagactttcacttccgccttacctcccagacctctgcccattggcacggccttctctgtgaccgtcgactcttcctggatatcccatatcaggccttggatcaaggcaaccgggaaagtttgactgcaaccctggagtacgtggaagagaagacaaatgtggactctgtgtttgtgaacttccagaatgatcggaacgacagaggtgccctgctgcgggccttcagctacatgggctttgaggtggtcagaccagatcaccctgccctccctcccttggacaatgtcatctttatggtgtatccccttgaaagggatgttggccacctgcccagtgagcctccttgaacatgcttattccaacgctttgaggggctggaagccttgacacatggaatcaggggcccgggatgtgattcaggacactttccatcctaggaataaagggtagtgcaatcaaaaaaaaaaaaaaa

SEQ ID NO: 173 - DNA, 1217 bp, Mus musculus
tgagtagaattaaaacagccagaggatttagcaagttacagcaaccctctggattcctggttatccagtacaggaacatactccaataaattcagaacacacaaatggcggaaggtccctccttgcatccaaaactccaagtggattcgaatatacccatagaaataagttcccaaatacctcaagaaccggcaaggaacctagcttttcaaatgcgtcagagtcccctagtgaccccaggaagtacaacgaaatcaagtctttcagtccctgaaaggaacctacttaagcaagagtctcaaggaccatcaagacaatcaggttgtatgctactgtcagataaatatgttaacaaacaaactggcccaatggcttcaagaaagtttcgaaaagaacgaactgtgtacaccaaagaacagcagggcctgctgcaaaaacattttgatgagtgccagtacccaaacaagaagaaaattgtggagctggcactatcagttggtgttacaaagagggagattaagatctggttcaagaacaaccgagctaagtacaggcggatgaacctccagaatattgaacaagtactgccagagtcaaatggaagctctaaagcggtttctgagtcaacccattttcctgttgttgcctctgacaatggagagtccatgtgttcaggcacatttggtgaggattccattcccaaattcaactgcagctaggaatcttccctgcattgttttcaggcctgagatggggccatgtgttgtacgcaagaatacgtgcttgatggccatacccctgttacagcttggaactctggtcaatcagcagcagttgaatatcacacttacttagcagtagctgaagctccagtcgggctggcatatgctgcccaagccccagaggatgctcacaattcagctccatctgcagacaagctctagcaaaggatccttgaagacttttgacacatcagatgactggcttgccatgagaaacccctccactccagcttacacctctcaggtccttgacgagtccaaccttacagccatgaagaagtgtgttatatacacctttattctctgtatttggagaaataaccagtcttatctgtagaagcatcataccactgtgttttatgtagtgcgattgtttgaaattcagtttaggtcttaattttttattgttagagtatatgttcattaaataaaagg

SEQ ID NO: 174 - DNA, 1343 bp, Mus musculus
tgagaattaaggatttgaatattgcaagtgggtggagccagcgtgaaggaggagcattgaattccaagtttgcagagatatataagggcaggtcttctgagtagaattaaaacagccagaggatttagcaagttacagcaaccctctggattcctggttatccagtacaggaacatactccaataaattcagaacacacaaatggcggaaggtccctccttgcatccaaaactccaagtggattcgaatatacccatagaaataagttcccaaatacctcaagaaccggcaaggaacttagcttttcaaatgcgtcagagtcccctagtgaccccaggaagtacaacgaaatcaagtctttcagtccctgaaaggaacctacttaagcaagagtctgaaggaccatcaagacaatcaggttgtatgccactgtcagataaatatgttaacaaacaaactagcccaatggcttcaagaaagtttcgaaaagaacgaactgtgtacaccaaagaagagcagggcctgctgcaaaaacattttgatgagtgcagtacccaaacaagaagaaaattgtggagctggcactatcagttggtgttacaaagagggagattaagatatggttcaagaacaaccgagctaagtacaggcagatgaacctccagaatattgaacaagcactgccagagtcaaatggaagctctaaagcggtttctgagtcaacccattttcctgttgttgcctctgacaatggagagtccatgtgttcaggcacatttggtgaggattccattcccaaattcaactgcagctaggaatcttccctgcattgttttcaggcctgagatggggccatgtgttgtacgcaagaatatgtgcttgatggccatacccctgttacagcttggaactctggtcaatcagcagcagttgaatatcacacttagcagtagctgaagctccagtcgggctggcatatgctgcccaagccccagaggatgctcacaattcaggtccatctgcagacaagctctggcaaaggatccttgaagacttttgacacatcagatgactgtcttgccatgagaaacccctccactccagcttacacctctcaggtccttgacgagtccaaccttacagccatgaagaagtgtgttatatacacctttattctctgtatttggagaaataaccagtcttatctgtagaagcatcataccactgtgttttatgtagtgcgattgtttgaaattcagtttaggtcttaattttttattgttagagtatatgttcattaaataaaaggagaaaatagtacttttaaaaaaaaaaaaaaaaaa

SEQ ID NO: 175 - DNA, 1603 bp, Mus musculus
aaaacagccagaggatttagcaagttacagcaaccgtctggattcctggcagaggtccaagtcctggattgtatagagaacccgacatcaaccaatggagaggcctgcttctaggacgaaggttctccagtacaggaacatactccaataagttctgaacacacacatggccgaaggcccctccttgcatccaaaactccaagtggcttcgaatatacccatagaactcagttcccaaatacctcaagaccctgcaaggaacttagcttttcaaatgtgtcagaatcccctaatgactccaggaagtacaatgcaatcaagactttcagtccctgaaaggaacctacttcagcaagagtctcaaggaccaacaagacaatcaggtcgtatgccactgtcagatagatatgttaacaaacaaactggccctatggctttaagaaagtttcgaaaagaacgcactgtgtactccaaagaacagcagtgcctgctgcaaaaacattttgatgagttccagtacccaaacgagaagaaaattgtggagctggcactatcagttggtgttacaaagagggagatcaagatctggttcaagaacaaccgagctaagtacaggcggatgaagctccagaatataaaacaagcactgccagagacaaatgaaagctctaaagcggtttctgagtcaacccattttcctggttccatacctgttgttgactcggacaatggagagtccatgtgttcaggcacatttggtgaggattccattcccaaactcaactgcagccaggaatcttccctgcattgttttcaggcctgtgatggggacatgtgttgtccgcaagaataccaagaataccaagaatacctgcttcatggccatgcccctgttacagcttggaactctggtcaatcagcagcatttgaatctcaaactgacttagcagtagctgaagttccagtcggcctggcatatgccgcccaagccccagaggatgctcacaattcaggtccatgtgaagatgagctctggcaaaggatccttgaagacttggacacatcagatgactggcttactctgagaaacctctccactccagtttacaccactgaggtccttgaccagtccaagccttacagccatgaagaagtgtgttatacacacctttagtgtcagtatttggagaaaattttattttacttttttattgggtatttatttcatttacatttccaatgctatcccaaaagacccccctaccctccccccttcccttcccacttcttggccctggcattcccctgtactgaggcagataaagtttgcacgaccaatgagtgtaatcactttgagagcacataattcggagtccattggtagaaaatgatactttgtttagtatatatttggggtggctgtggattcatgcaatatagggactcgctatcaagtctaactccagttatatgattacctacgccctctccttgcttcagaggtcactacatgcaacaggaaccctcatatacatgcagaacttgcaatcatatgatagaaaagcaatacatctgataaataaatactgtgagccaactcccc

SEQ ID NO: 176 - DNA, 1186 bp, Mus musculus
gttctccagtgcaggaacattctccaatcagttcagaacacatagatgtccaaagattcctccttgcatcctaaataccaaatggcttcaaatatacccagagaaaccagtttcctagtgcctaaagagcctacaaggtacttaccttttcaaatgtgtcagagtcctctagtgaccccaacacgtccactgcaatcaagtcattcagtccatgaaagggacctacatcagaaagactcccaagaaccatccagaaactcaggttctatgccactgtcagataaatattataacaaacaatctggccctgtggctacaagaaagtgtcgaaaggaacgcaccgtgtactccaaagaacaaaagtgtctgctgcaagaacattttcaccagtgccagaacccagacctggaacaacggaaggcactggcattactgattggtgtgacagaatacaagatccagacctggttcaagaacagacgagctaaagaatgtcggaagagttcacaactccctcggagaattggaagtggacctcactataggcctacttccagcagtggcggtgaagttcctgatttcgctgccagtccagattctgtgtgccagagacatgtgaatgtcagctatcctcctgagtttagaccatcaaggaactcccctcaccaggaattcaactcttccctcattgatcaacccttggaagacatgtgtttcagcaagagccacattatctcggagcatccaaggcagaagtgtagagaactttccagggaaccggggcacctatctagtgataggtctggctgttccaacgttctttcctcaccttctccagcagccggtgctgaatcttcgtgtgacataccctcgggattaagcctttctcctcaactcggacctccaagtatgacccaaaactcagaatccaccttctccatgtgccagacaccatcagttttgagccctcttcctgaactcagccccttgagtaattccctagaccagatggccatcttttccaaaattgatcaggtctgtgaaatctatcaaaagaatacaaggtctaagaagcaaaggaaggagacagagaagaacacggtgcaaaatttgatgcatggccaggattcctgtgaaataactgaaagccctaaaggcactgtctctctgccaagctctgcctatc

SEQ ID NO: 177 - DNA, 1336 bp, Mus musculus
agaagtcaaacagaggattgggcaaactatagcaaccctctgatttcaggttctcctgtaggaacatgcttcaatacaatcagagcccacatatgccccaagatccctccttgcattcaaaattccaaatgtcttcaagtgcacccatagaaatcagttttcaaatgcatcaagaacctgcaaggaatttgcctttccaaatgtgccagagtcctctagtgatcccaagaagtccaatgcaatcaagtcattcagtccctgaaagggacctatgtccgcaagagtcccaaggtccatcaggaaaatcaagtatacaaatgcaaccaggtcttgtaatggacccagctttaccaattctgagaagcctcttaatgcattcacctcatcagataccttcaagatcctcagtgagagctggtttccagggttctctaggacctatggtgcggtcacctagttatggtgaccgacgagtcagccttgtgactccaaggaagcaccggaaaatacgcactgtatacaccgaggaacaaaagtgtgtgctgaaaaaacattttcataagtgcacatacccaagccgggagcaacgcatggcactggcagttttggttggtgtcacagcaaatgagatccagatctggttcaagaaccaccgggctaagtccaagcgggagagtctccagaatgttccagcagcactgccagagacaaatggaagctctgaagctgtttctgagtcagtccactttcctgattccttacccgttgttgcttctgccaatggagagtccatgtggtcaggcacatttggtgaggattccattcccaacctcaactggagccaggaatcttctccgcctcattatcaggcctgtgatagtgccaggtattgtccgcaagaatacctgcttaatggccatgcccctgttacagcttggaactctggtcaatcagtagcagttgaagtccagactggcttagcagtagctgaagctccagtcgtcatggtagcttccacccaaggtccagagtatgctcaagattcaggtccatctacagaggagctctggcaacgggttcttgaagactttgatgagttgggggattgagatacacccccataaaacacctctcaccccccttgacttatccaggcctttatagaaaggaagatgtttgttagtgtatttggagaaattaagtaggtctatctgtagtagtttcatgtcactggtttatgtagtgggattgtttaaaaaacatggaaaatattcctcccttattgttgaattacatattctttaaataaaagaaagaaaacatttactggagaatt

SEQ ID NO: 178 - DNA, 1409 bp, Homo sapiens
gagtagtcccttcgcaagccctcatttcaccaggcccccggcttggggcgccttccttccccatggcgggacacctggcttcggatttcgccttctcgccccctccaggtggtggaggtgatgggccaggggggccggagccgggctgggttgatcctcggacctggctaagcttccaaggccctcctggagggccaggaatcgggccgggggttgggccaggctctgaggtgtgggggattcccccatgccccccgccgtatgagttctgtggggggatggcgtactgtgggccccaggttggagtggggctagtgccccaaggcggcttggagacctctcagcctgagggcgaagcaggagtcggggtggagagcaactccgatggggcctccccggagccctgcaccgtcacccctggtgccgtgaagctggagaaggagaagctggagcaaaacccggaggagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctccgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcctgggacacagtagatagacacactta

SEQ ID NO: 179 - DNA, 2075 bp, Homo sapiens
ggaaaaaaggaaagtgcacttggaagagatccaagtgggcaacttgaagaacaagtgccaaatagcacttctgtcatgctggatgtcagggctctttgtccactttgtatagccgctggcttatagaaggtgctcgataaatctcttgaatttaaaaatcaattaggatgcctctatagtgaaaaagatacagtaaagatgagggataatcaatttaaaaaatgagtaagtacacacaaagcactttatccattcttatgacacctgttacttttttgctgtgtttgtgtgtatgcatgccatgttatagtttgtgggaccctcaaagcaagctggggagagtatatactgaatttagcttctgagacatgatgctcttcctttttaattaacccagaacttagcagcttatctatttctctaatctcaaaacatccttaaactgggggtgatacttgagtgagagaattttgcaggtattaaatgaactatcttcttttttttttttctttgagacagagtcttgctctgtcacccaggctggagtgcagtggcgtgatctcagctcactgcaacctccgcctcccgggttcaagtgattctcctgcctcagcctcctgagtagctgggattacaggtgcgtgccaccgtgcccagctaatttttgtgtttttagtagagacggggtttcaccatgttggccatgctggtcttgaactcctgacctcgtgatctgcccacctcggcctcccaaagtgctggaattataggcgtgagccaccgcgcccagcaaagaacttctaaccttcataacctgacaggtgttctcgaggccagggtctctctttctgtcctttcacgatgctctgcatcccttggatgtgccagtttctgggggaagagtagtcctttgttacatgcatgagtcagtgaacagggaatgggtgaatgacatttgtgggtaggttatttctagaagttaggtgggcagcttggaaggcagaggcacttctacagactattccttggggccacacgtaggttcttgaatcccgaatggaaaggggagattgataactggtgtgtttatgttcttacaagtcttctgccttttaaaatccagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctccgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcctgggacacagtagatagacacacttaaaaaaaaaaa

SEQ ID NO: 180 - DNA, 1589 bp, Homo sapiens
ggaaaaaaggaaagtgcacttggaagagatccaagtgggcaacttgaagaacaagtgccaaatagcacttctgtcatgctggatgtcagggctctttgtccactttgtatagccgctggcttatagaaggtgctcgataaatctcttgaatttaaaaatcaattaggatgcctctatagtgaaaaagatacagtaaagatgagggataatcaatttaaaaaatgagtaagtacacacaaagcactttatccattcttatgacacctgttacttttttgctgtgtttgtgtgtatgcatgccatgttatagtttgtgggaccctcaaagcaagctggggagagtatatactgaatttagcttctgagacatgatgctcttcctttttaattaacccagaacttagcagcttatctatttctctaatctcaaaacatccttaaactgggggtgatacttgagtgagagaattttgcaggtattaaatgaactatcttcttttttttttttctttgagacagagtcttgctctgtcacccaggctggagtgcagtggcgtgatctcagctcactgcaacctccgcctcccgggttcaagtgattctcctgcctcagcctcctgagtagctgggattacagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctccgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcctgggacacagtagatagacacacttaaaaaaaaaaa

SEQ ID NO: 181 - DNA, 1840 bp, Mus musculus
gattcatagcaaggagaggaagtatagattaggtctcttggagcctggagtcacagctttcccttgcccgaatatggtgatctgtctccattgtccagatcaggatgattctttagaagaagtcacagaggaatgctattccccacccaccctccagaacctggcaattcagagtctactgagggatgaggccttggccatttctgctctcacggacctgccccagagtctgttcccagtaatttttgaggaggccttcactgatggatatatagggatcttgaaggccatgatacctgtgtggcccttcccatacctttctttaggaaagcagataaataattgcaacctggagactttgaaggctatgcttgagggactagatatactgcttgcacaaaaggttcaaaccagtaggtgcaaactcagagtaattaattggagagaagatgacttgaagatatgggctggatcccatgaaggtgaaggcttaccagatttcaggacagagaagcagccaattgagaacagtgctggctgtgaggtgaagaaagaattgaaggtgacgactgaagtccttcgcatgaagggcagacttgatgaatctaccacatacttgttgcagtgggcccagcagagaaaagattctattcatctattctgtagaaagctactaattgaaggcttaaccaaagcctcagtgatagaaatcttcaaaactgtacacgcagactgtatacaggagcttatcctaagatgtatctgcatagaagagttggcttttcttaatccctacctgaaactgatgaaaagtcttttcacactcacactagatcacatcataggtaccttcagtttgggtgattctgaaaagcttgatgaggagacaatattcagcttgatttctcaacttcccacactccactgtctccagaaactctatgtaaatgatgtcccttttataaaaggcaacctgaaagaatacctcaggtgcctgaaaaagcccttggagacactttgcatcagtaactgtgacctctcacagtcagacttggattgcctgccctattgcctgaatatttgtgaactcaaacatctgcatattagtgatatatatttatgtgatttactccttgagcctcttggttttctccttgagagagttggagataccctgaaaaccctggaattggattcatgttgtatagtggactttcagttcagtgccttgctgcctgccctaagccaatgttctcacctcagagaggtcactttctatgataatgatgtttctctgcctttcttgaaacaacttctacaccacacagccctgctgagtcagctgatctatgagtgttaccctgcccctctagagtgctatgatgacagtggtgtaatactaacacacagattagaaagtttttgtcctgagcttctggatatactgagagccaaaagacagctccatagtgtctcctttcaaacaaccaaatgctctaaatgtggtgggtgctacatttatgatcggcatacccaatgttgccgttttgtggaactactataagcttgattgtgaaactgagaaatagaaacttagtattggggactgatgaaatcctaagtgaatgtccactgctaaatggagcatgaaaatgtcaatcacctaaaagtctgagatacacaggaaagtcaataacttcctctgagctggtgaatggatgttgcatctgtagaaagtatcaagcacttgtagtttgaatgtgttacaatagaagcaccattttatgagactggcccaatctgttgactgcatacaataaatctgttgactttttaaaaa

SEQ ID NO: 182 - DNA, 1929 bp, Mus musculus
tcagtttttgaaaccaggagttgcagctttcccctgcctgaatatggtgatgtgtaaccattgtccagatcaaggactggagaattaaacacagtctcttcatcatccaacacctgactgaggcttcagagtttctgcatgactctttagaagaagacacaatgaatttctattcgccacccactctgatggagctagcaagacagtgtctactgagggatgagtacttggccatttctgctctcaaggacctgcccaatatgatgttcccagtgatgtttaaggaggcatttattgatggacatacaaagatcttgactgccatgatacctgtgtggcccttcccatacctttctgtaggaacgatgctaaagaacctcaacttagacactttgaaggctgttcttgaggagatagatatactgatttcaaaaccagttttttccagtaggtgcaaactcagagagatcactttgagccatgatttggttgtggtatgggctggatcccatgaagttgaaggcttaccagagttcatggaacaggagaagccagttgagaatagtcctggctatgggacaaagaacaaattgaaagtgacaacagaactccaattcatggagggccaccttgatgaatgttccacttacttgttgcagtgggcctaccagagagaagattccattcatctacactgtagaaagctgaaaatttatggcttaaccaaagccgcagtcatagaaatgttcaaaattgtacatgcagaatatatagaagatctggaactatcttgtctttgcctagaatatttggattttcttaatccctatctgaaacagatgagcaatctactctcactcacactagatgagatcatatataccctcaatatagatgattatagaaatcttaatgaggaaaaagtgattacagtgatttctcatcttcctacattccaccatctccaggaactctatgtacatggtgtcatttttatagaatgtctcaggtgcctgaagaagcccttggaagtactttcgttcactgactgtgacctctcacagtcagacttggattacctcccctattgcctgaatatttttgagctcagatctctccacctgactgatgtacgtttaagtaatttacttcttgagccccttgggtttctccttgagagagttagacataccctgaaatccctgcaattaatgtcatgtgaaatgggggaaactcacttcaatgccctgctgcctgccctaagtcaatgttaccagctcacagtagttaatttctatggtaatgaactctctctgcttttcctgaaaaaacttctacaccacacagctaagcttagccagctagctgatgagctataccctgcccctcaggagtgctatgataatagggatgtagtactatcacacagattagaaaatttttgttctgagctcctggatatactcagggccataagagagcccaagaaagtcacctttggtacaatcaaatgctccaagtgtggtgggtcctatgtttatgatctggagacccaatgttgcttttttgaaaagaaccctccctgggcttgattttggaagagagaaatggtagcgtactattgggaattgatatcctaagtgaatgtcccttgctggaaggaacatagatgtgtcaaccacctaattttctgagacacattgaaaagaaataattgtcctcagagctggtgaagagtattgcatctacaaaagatgttaagcactattttattctctaggattattgtagtttgtgtgtgttacaatacaggcatccttgcatgaaaatgttgttcccatctgttgactgcatacaataaatgtgttgactttctggggtgctggtatgtctcaatcagagcacagagcctaatcattcccagcatct

SEQ ID NO: 183 - DNA, 1868 bp, Mus musculus
cttgggttcttggaggttggaatcatagcctacctcagtctgactatgatgatctgtcaccagtgtctagatcaagatgactcttcagaagaagaagaagcagttagtgtctactccccatccaccctggtgaaactggcaagacagaggctactgagggaggaggctttggtcatttctgctctcaagggcctgccaaatatgctgttcccagtgatatttgaggaggccttcattaatggtcatacaaagatcttgaaggccatgatacctatgtggcccttcccatacctttctgtaggagcactgacaaacaactgcaacctgaagactttgaaggctgttcttgatggactagatatacttcttgcacaaaaggttcgctccagtaggtgcaaactcagagtactcaaatggagagatgaacagcatgacttttgtgggatatggcctggatcccatgaagctgaagacttaccagagttaatgacacagaagcatcccgtgcagaacaaccctgactgtggggtaaagaaagaattgagggtaacaactgaactctctgtcatgaagggcagacttgatgattctgccacatacttgttggagtgggcccagcagagaaaagattccattcacctactctgcagaaagctggtaattgaaaccttaaccaaagacacagtgatagaaatcttcaaaattgtaaatgcagattgtatacaggagctggagctgtattctctttgcctagaagatttggcttttcttaatccctacctgagacagatggacaatcttcttgaactcacacttgatcacgtcacagattccctcagtatgggtgattctgaaatgtgtgaggaagaaatgatcacattggtttctcaacttcccacatttccctgtctccagaaactctgtgtaaatgatgtctactttatatatggcaacctgaatgaaatcctcaggtgcctgaagaagccattggtatcattttgcatcagtaactgtgaactctcacagtcagacttggattgcctgccctattgcctgaatatttttgagctaaaatgtttgtaccttattgatatacctttaaatcatttatgccttgatcctctcgggtttctccttgagagtgttagacataccctggaatgcttggaattaaagtcatgtgatatgggggaacctcaattcaatgccctgctgcctgccctaagtcaatgttcccacctcacagatgtcagtttttgggaaaatgaactctctctgctgttcctgaaacaacttctacagcacacatccaagctgactcagctgagctatgagctgtaccctgcccctcttgagtgctatgatgacaggggtttaatactatcacacagattagaacaattttgtcccgaactcctggatatactcagggccaaaagacagcccaaggatattgcctttgttacaaacccatgttctaaatgtggtagatactatgtttatgatccaaagacccaacgtttctctttggaagacacaaccctgtaaggttgattgtggaacagagaaatgcaagcttagtattggggatcgatgaaatcttagttgaatttcccttggttaaaggaacatggatttgtcaatcatgtaaaggtctgagataaacaataaaaatgcaagatattcctctgagctagtgaatgaatgtaccatctgcaagaagtgtcaagcatgcttttattctctaggattattgtagattgagtatgttacaatagaggcaaacttccatgaggatattgttctcctttgttgactgcatataataaatgtgttaactttgttttatttttaaaaaaaaaaaaaaa

SEQ ID NO: 184 - DNA, 1853 bp, Mus musculus
ggtctcttggagcctggagacacagccttcccctgcctgaatatggcgagctgtgaagagtgtccacctcaaaatgtatctttcgaagaagacattgtgaatatcaaccccccacccgccctccagaacctggcaattcagagtctactgagggatgaggccttggccatttctgctctcaagaacctaccccagaatctgttcccagcaatttttgaagcagccgtaattggtggacgtatagagatcttgaaggccatgatacctgtatggcccttcccatacctttctttaggaaagctgataaagaattgcaacctggagactttgaaggctatgcttgagggagtggatatactgcttgcacaaaatgatcgctccagtagatgcaaactcagagtgctcgatttaaggaatgaataccatactttgtggagaatatggggtggatcctatgaaggtagaggcttgccagagttcatgacacagcagcagccaatggagaactgtcctgactgtggggtgaataaagaattgaaggtgacaactgacctcaacctcgtggatggtggacttgatgaatctgccacatacttgttgcagtgggcccagcagaaaaaagattccattcatctatgctgtacgatgttgagaattcatagcttacccaaagacatattcagagatatcctcaaaattgtaaatacaggctgtatacaggagcttcacttgaaggaattgtacacagaagagttggtttttcttataccttacctgagagaaatgaacaatcttcttacattcatgctaagtagcatcagagaaacctgcagaatggataactcgacaaggcttgatgaagagaatataagcaggtttatttctcgccttcccaaattccactgtctgcagaatctctatgtaaatgatatcacccttctaggaaacaacctgaaagacttcctcaggtgcctggggaagcccttggagactctttgcctcacttcttgtgacttatcacagtcagacttggattacctgccctgttgccagaatacttctgcactcaaacgtctgaacctgactgctacaagtttgcgtggtttagtctttcatcctcttggagttctccttgagagtgttagaggtacactgcaatccctggaattagagttgtgttttatggaggactctcagatcagtgccattttgcctgccctaagccaatgttcccatctcacaaaggtcaatttctatgataatgaactctctctgcctatcctgagacaacttctataccacacagccaacctgagccagctgacctatgaggtataccctgcccctctagagtgctataatgacatgaatataatactaacacataagttagaaaatttttgtcctgagcttctggacataatcagggccaataggcagcccaacagagtcacatttgctacatccaaatgtttaatctgttgtgggtcctacgtttatgatctggagacccagagctgcctataccagaaagatctactggaagattgattgtggaacaaagaaatggaagctgagtattagaaatggacaaaattgtaagtcgatgtcaattgctgataggagcatggttatgtcaagcacctaaatgtctgacacacattggaaaggcaagatcttcctctgagcaagagaatggatgttgcatctgcaaaaagtgccaagcactcttttcttctcttgtactattgtagtttgagtgtgtcataataggggcacccttctatgagaagattgtccccctttattaagtgcatacaataaatgtgttaactttcaaaaaaaaaaaaaaa

SEQ ID NO: 185 - DNA, 1996 bp, Mus musculus
ggtctcttggagcctggagacacagccttcccctgcctgaatatggcgagctgtgaagagtgtccacctcaaggcctggagagctaagcacagtctagtcatcatcaatcggctaactgagcctttagggttcctggtgatccctttccagtgggatatattcaccccaactgtgactgcaattggatgtggccttcgggaactaggatactttgaatgtatctttcgaagaagacattgtgaatatcaaccccccacccgccctccagaacctggcaattcagagtctactgagggatgaggccttggccatttctgctctcaagaacctaccccagaatctgttcccagcaatttttgaagcagccgtaattggtggacgtatagagatcttgaaggccatgatacctgtatggcccttcccatacctttctttaggaaagctgataaagaattgcaacctggagactttgaaggctatgcttgagggagtggatatactgcttgcacaaaatgatcgctccagtagatgcaaactcagagtgctcgatttaaggaatgaataccatactttgtggagaatatggggtggatcctatgaaggtagaggcttgccagagttcatgacacagcagcagccaatggagaactgtcctgactgtggggtgaataaagaattgaaggtgacaactgacctcaacctcgtggatggtggacttgatgaatctgccacatacttgttgcagtgggcccagcagaaaaaagattccattcatctatgctgtacgatgttgagaattcatagcttacccaaagacatattcagagatatcctcaaaattgtaaatacaggctgtatacaggagcttcacttgaaggaattgtacacagaagagttggtttttcttataccttacctgagagaaatgaacaatcttcttacattcatgctaagtagcatcagagaaacctgcagaatggataactcgacaaggcttgatgaagagaatataagcaggtttatttctcgccttcccaaattccactgtctgcagaatctctatgtaaatgatatcacccttctaggaaacaacctgaaagacttcctcaggtgcctggggaagcccttggagactctttgcctcacttcttgtgacttatcacagtcagacttggattacctgccctgttgccagaatacttctgcactcaaacgtctgaacctgactgctacaagtttgcgtggtttagtctttcatcctcttggagttctccttgagagtgttagaggtacactgcaatccctggaattagagttgtgttttatggaggactctcagatcagtgccattttgcctgccctaagccaatgttcccatctcacaaaggtcaatttctatgataatgaactctctctgcctatcctgagacaacttctataccacacagccaacctgagccagctgacctatgaggtataccctgcccctctagagtgctataatgacatgaatataatactaacacataagttagaaaatttttgtcctgagcttctggacataatcagggccaataggcagcccaacagagtcacatttgctacatccaaatgtttaatctgttgtgggtcctacgtttatgatctggagacccagagctgcctataccagaaagatctactggaagattgattgtggaacaaagaaatggaagctgagtattagaaatggacaaaattgtaagtcgatgtcaattgctgataggagcatggttatgtcaagcacctaaatgtctgacacacattggaaaggcaagatcttcctctgagcaagagaatggatgttgcatctgcaaaaagtgccaagcactcttttcttctcttgtactattgtagtttgagtgtgtcataataggggcacccttctatgagaagattgtccccctttattaagtgcatacaataaatgtgttaactttcaaaaaaaaaaaaaaa

SEQ ID NO: 186 - DNA, 2219 bp, Homo sapiens
aaatctccctgagagcgggaccggcctcagctccaacacagcctccactgtgattaaaaataaaaattgctagagcagccctcactcgccacatctactttgatagctggctatttggaatttaaaggatatttgactttttctaacctcccatgaggctgtaagttccactgctccaaacccacccaccaaggactctgaacctgtccaccccgggcgcatcaagatcttccagctgggtacccccgatttgggccgactttgcacctccaaacaaccttagcatgatgtcttatcttaagcaaccgccttacgcagtcaatgggctgagtctgaccacttcgggtatggacttgctgcacccctccgtgggctacccggggccctgggcttcttgtcccgcagccaccccccggaaacagcgccgggagaggacgacgttcactcgggcgcagctagatgtgctggaagcactgtttgccaagacccggtacccagacatcttcatgcgagaggaggtggcactgaaaatcaacttgcccgagtcgagggtgcaggtatggtttaagaatcgaagagctaagtgccgccaacaacagcaacaacagcagaatggaggtcaaaacaaagtgagacctgccaaaaagaagacatctccagctcgggaagtgagttcagagagtggaacaagtggccaattcactcccccctctagcacctcagtcccgaccattgccagcagcagtgctcctgtgtctatctggagcccagcttccatctccccactgtcagatcccttgtccacctcctcttcctgcatgcagaggtcctatcccatgacctatactcaggcttcaggttatagtcaaggatatgctggctcaacttcctactttgggggcatggactgtggatcatatttgacccctatgcatcaccagcttcccggaccaggggccacactcagtcccatgggtaccaatgcagtcaccagccatctcaatcagtccccagcttctctttccacccagggatatggagcttcaagcttgggttttaactcaaccactgattgcttggattataaggaccaaactgcctcctggaagcttaacttcaatgctgactgcttggattataaagatcagacatcctcgtggaaattccaggttttgtgaagacctgtagaacctctttttgtgggtgatttttaaatatactgggctggacattccagttttagccaggcattggttaaaagagttagatgggatgatgctcagactcatctgatcaaagttccgagaggcatagaaggaaaaacgaagggccttagaggggcctacaaaccagcaacatgaaatggacaaaccaatctgcttaagatcctgtcatagttttagatcattggttatcctgatttgcaaagtgatcaaaagcattctagccatgtgcaaccaaacaccaccaaaaataaaatcaaacaaaactaagttgtgaaggaagggagggaaggtcatagccttcttaagcagaggtgttccattgttttagccaatccttggttgaatcttaggaatgaacagtgtctcaagctcattcacgtttcatgaccaactggtagttggcactgaaaaaacttttcagggctgtgtgaattgtgtgactgattgtcctagatgcactactttatttaaaaaataatgttcataaggagtcaatatgtagtttaagagacaatcagtgtgtgtcttataaatggtacatctgtggtttttaatctgtgctagacttcaaaactgtgatctcctgttattgtatgcaaccttgaactccacctctgcaggggttcttctgtgattaaataggttataattataagcaaaattcagagcaactgagtactgatctaaaaagattacctttggctggaggtgagctgcactgaaactttacgacaaaatgtctctggacaaagagagtcagagaagagaagcaaaaggacactaattcatctgtaatttactgttggtaagcctagcagtaaagagacattggtcaattgctctgaccctgatgaattattaaactgagatcattgtcgtttatgcttgcagatgttaaatggaaaagttatatatgcataaaccttttcttcctggatttggcagatatgtataattatattaaaatggttctagcacaaaaaaaaaaaaaaa

SEQ ID NO: 187 - DNA, 2118 bp, Homo sapiens
tttttaagttagtgctggaacgtggaagagctgctgcctccgaagcagtaaaccagcccctctgtttgtttgtttgctttgcccttagttccactgctccaaacccacccaccaaggactctgaacctgtccaccccgggcgcatcaagatcttccagctgggtacccccgatttgggccgactttgcacctccaaacaaccttagcatgatgtcttatcttaagcaaccgccttacgcagtcaatgggctgagtctgaccacttcgggtatggacttgctgcacccctccgtgggctacccggccaccccccggaaacagcgccgggagaggacgacgttcactcgggcgcagctagatgtgctggaagcactgtttgccaagacccggtacccagacatcttcatgcgagaggaggtggcactgaaaatcaacttgcccgagtcgagggtgcaggtatggtttaagaatcgaagagctaagtgccgccaacaacagcaacaacagcagaatggaggtcaaaacaaagtgagacctgccaaaaagaagacatctccagctcgggaagtgagttcagagagtggaacaagtggccaattcactcccccctctagcacctcagtcccgaccattgccagcagcagtgctcctgtgtctatctggagcccagcttccatctccccactgtcagatcccttgtccacctcctcttcctgcatgcagaggtcctatcccatgacctatactcaggcttcaggttatagtcaaggatatgctggctcaacttcctactttgggggcatggactgtggatcatatttgacccctatgcatcaccagcttcccggaccaggggccacactcagtcccatgggtaccaatgcagtcaccagccatctcaatcagtccccagcttctctttccacccagggatatggagcttcaagcttgggttttaactcaaccactgattgcttggattataaggaccaaactgcctcctggaagcttaacttcaatgctgactgcttggattataaagatcagacatcctcgtggaaattccaggttttgtgaagacctgtagaacctctttttgtgggtgatttttaaatatactgggctggacattccagttttagccaggcattggttaaaagagttagatgggatgatgctcagactcatctgatcaaagttccgagaggcatagaaggaaaaacgaagggccttagaggggcctacaaaccagcaacatgaaatggacaaaccaatctgcttaagatcctgtcatagttttagatcattggttatcctgatttgcaaagtgatcaaaagcattctagccatgtgcaaccaaacaccaccaaaaataaaatcaaacaaaactaagttgtgaaggaagggagggaaggtcatagccttcttaagcagaggtgttccattgttttagccaatccttggttgaatcttaggaatgaacagtgtctcaagctcattcacgtttcatgaccaactggtagttggcactgaaaaaacttttcagggctgtgtgaattgtgtgactgattgtcctagatgcactactttatttaaaaaataatgttcataaggagtcaatatgtagtttaagagacaatcagtgtgtgtcttataaatggtacatctgtggtttttaatctgtgctagacttcaaaactgtgatctcctgttattgtatgcaaccttgaactccacctctgcaggggttcttctgtgattaaataggttataattataagcaaaattcagagcaactgagtactgatctaaaaagattacctttggctggaggtgagctgcactgaaactttacgacaaaatgtctctggacaaagagagtcagagaagagaagcaaaaggacactaattcatctgtaatttactgttggtaagcctagcagtaaagagacattggtcaattgctctgaccctgatgaattattaaactgagatcattgtcgtttatgcttgcagatgttaaatggaaaagttatatatgcataaaccttttcttcctggatttggcagatatgtataattatattaaaatggttctagcacaaaaaaaaaaaaaaa

SEQ ID NO: 188 - DNA, 2195 bp, Homo sapiens
aaatctccctgagagcgggaccggcctcagctccaacacagcctccactgtgattaaaaataaaaattgctagagcagccctcactcgccacatctactttgatagctggctatttggaatttaaaggatatttgactttttctaacctcccatgaggctgtaagttccactgctccaaacccacccaccaaggactctgaacctgtccaccccgggcgcatcaagatcttccagctgggtacccccgatttgggccgactttgcacctccaaacaaccttagcatgatgtcttatcttaagcaaccgccttacgcagtcaatgggctgagtctgaccacttcgggtatggacttgctgcacccctccgtgggctacccggccaccccccggaaacagcgccgggagaggacgacgttcactcgggcgcagctagatgtgctggaagcactgtttgccaagacccggtacccagacatcttcatgcgagaggaggtggcactgaaaatcaacttgcccgagtcgagggtgcaggtatggtttaagaatcgaagagctaagtgccgccaacaacagcaacaacagcagaatggaggtcaaaacaaagtgagacctgccaaaaagaagacatctccagctcgggaagtgagttcagagagtggaacaagtggccaattcactcccccctctagcacctcagtcccgaccattgccagcagcagtgctcctgtgtctatctggagcccagcttccatctccccactgtcagatcccttgtccacctcctcttcctgcatgcagaggtcctatcccatgacctatactcaggcttcaggttatagtcaaggatatgctggctcaacttcctactttgggggcatggactgtggatcatatttgacccctatgcatcaccagcttcccggaccaggggccacactcagtcccatgggtaccaatgcagtcaccagccatctcaatcagtccccagcttctctttccacccagggatatggagcttcaagcttgggttttaactcaaccactgattgcttggattataaggaccaaactgcctcctggaagcttaacttcaatgctgactgcttggattataaagatcagacatcctcgtggaaattccaggttttgtgaagacctgtagaacctctttttgtgggtgatttttaaatatactgggctggacattccagttttagccaggcattggttaaaagagttagatgggatgatgctcagactcatctgatcaaagttccgagaggcatagaaggaaaaacgaagggccttagaggggcctacaaaccagcaacatgaaatggacaaaccaatctgcttaagatcctgtcatagttttagatcattggttatcctgatttgcaaagtgatcaaaagcattctagccatgtgcaaccaaacaccaccaaaaataaaatcaaacaaaactaagttgtgaaggaagggagggaaggtcatagccttcttaagcagaggtgttccattgttttagccaatccttggttgaatcttaggaatgaacagtgtctcaagctcattcacgtttcatgaccaactggtagttggcactgaaaaaacttttcagggctgtgtgaattgtgtgactgattgtcctagatgcactactttatttaaaaaataatgttcataaggagtcaatatgtagtttaagagacaatcagtgtgtgtcttataaatggtacatctgtggtttttaatctgtgctagacttcaaaactgtgatctcctgttattgtatgcaaccttgaactccacctctgcaggggttcttctgtgattaaataggttataattataagcaaaattcagagcaactgagtactgatctaaaaagattacctttggctggaggtgagctgcactgaaactttacgacaaaatgtctctggacaaagagagtcagagaagagaagcaaaaggacactaattcatctgtaatttactgttggtaagcctagcagtaaagagacattggtcaattgctctgaccctgatgaattattaaactgagatcattgtcgtttatgcttgcagatgttaaatggaaaagttatatatgcataaaccttttcttcctggatttggcagatatgtataattatattaaaatggttctagcacaaaaaaaaaaaaaaa

SEQ ID NO: 189 - DNA, 3244 bp, Homo sapiens
ctctccggcgtctccgcctggaggggaagatgcggcctgcctggcccgccgcctcgcccccggcctcacggtgggaccccgggcactgaggacggaggtcccgggcgccggcccgcggggcaacgggcactaggtgagagccggacgcgggcgagcgaaggaggcgggtgccgggcgactccagcggcggcccctgcccctcccccgcacccacgaacacgctcgcccgatatattgcagaggcttctccggtcgccgctgcgccagtttttttttgtttgtttgttgtgttttccctggcaaacagctggagaaagagcagctcatggagaggctgagagaagcggttttcgcgtcctacccaaactgggagagtaaccttcagcagctggactcaccgattggttttccttcattttcagtgaaatcccattctctggctggagacacagatggcctcaaatgagagagatgctatatcgtggtaccaaaagaagattggagcctacgatcagcagatatgggaaaagtcaatcgaacagactcagattaagggtttgaaaaacaaaccgaaaaagatgggccacataaagccagacttgattgacgttgacttaatcagagggtcaacatttgccaaagcaaaacctgaaattccatggacatctctgactcggaaggggcttgttcgagttgtattttttccattgttcagcaattggtggattcaggttacctctttaagaatctttgtttggctgttactactttatttcatgcaagttatagcaattgtcttatatttgatgatgcctattgtgaacataagtgaagtacttggacccttgtgccttatgctactcatgggaactgtccactgtcaaattgtgtctactcagataacaagaccatcaggaaacaatggaaatcgaagaagaagaaaattacgaaaaactgtaaatggtgatgggagccgagaaaatggaaataactcctctgataaagtcagaggaatagaaactttggaatctgtacccattattggtggtttttgggagactatctttggcaacaggattaaaagagtaaaattaatatctaacaaagggactgaaactgacaatgacccaagttgtgtccatcctatcattaagaggagacaatgtcgaccagagattagaatgtggcaaacaagagagaaagcaaaattttcagatggagaaaagtgccgtagggaggcttttaggcgtttgggtaatggggtgtctgatgacctgtcaagtgaagaagatggtgaagcacggacacagatgatattattgcgtaggagtgtggaaggggcctcaagtgacaatggttgtgaagttaagaatagaaaatcaatactttcaaggcacctaaactctcaggtaaagaaaaccactacaaggtggtgtcatattgtgcgggattcagatagtctggctgaatcagaatttgaatcagcagccttcagccagggctctagatcgggtgtgagtggtggctctcgaagcctcaacatgtcaagaagagactcagaaagcacccgccatgactcggagactgaggacatgttatgggacgacctgctacatggcccagagtgccggtcatctgtcaccagtgacagtgagggggcccatgtgaatacccttcactcagggaccaaacgtgaccccaaagaggatgtttttcagcagaatcatttattctggcttcagaattcaagtccttcctctgatcgagttagtgcaataatctgggaggggaatgagtgcaaaaagatggatatgtctgtgttggaaataagtggcatcatcatgagcagggtcaatgcctatcagcaaggagtaggttatcagatgctgggaaatgttgtcactattggattagcattttttccattcttacatcgacttttccgtgagaagagccttgaccaactaaagtccatttcagctgaggagatcttgactctcttttgtggggcaccacctgttacacctattattgttttgtcgataattaatttttttgaaagattgtgtcttacttggatgttttttttcatgatgtgtgtggcagagagaacatataaacagagatttttatttgcaaaactcttcagccatattacttctgccaggaaagctaggaaatatgaaatacctcatttcagacttaagaaggtggagaatattaaaatatggttatcactgcgttcctatctaaagagacgggggccacagcgttcagttgatgtggttgtatcctcggttttcctactgacactttcgattgctttcatttgttgtgctcaggttctccaaggacataaaactttcctgaatgatgcttataactgggagtttttgatctgggaaacagctttactactttttttattgcgtctggcctcactggggtctgaaaccaataagaaatacagcaatgtttcaatattacttacagaacagattaatttatatcttaagatggaaaaaaagccaaataagaaagaacagcttactctagtaaacaatgtattaaagctgtccaccaagttgttgaaagagctggacacaccatttagactctatggactgacaatgaatcccttaatctacaatatcacaagagtagttatcctttctgctgtctcaggtgttataagtgatcttctaggatttaatataagactgtggaaaattaaatcataagctgagtaaatgcctggactctcccctggctggtatcaaaacttacctatcaaggaaagtgatgactgcagaaaccagtgagatacccacctgcttgttcacatgcacaggtgctctcagctctgccaaagcgaatgaatggtgtttccggaggagcaagtccttttccaactgggtgtgcatgctaaaaacctgtattttcatgcttttcaaacaacatgaatagtcagctgactaaagactgtgtgtgttgtggtaacacaaagacaattttgtaagtttgcgcttcagtactgtgacagttatgtttactggacatagtcttttgggcaactatgatagatgcccaaagcatgaagcaaatatcttttattggaaatatgcaaattcaatacttttccattatagtctatagaactggagatttcatttctctatcaaagagagatcaagcgaactattttaggttaaatccgaataaaagaactttactggagactttc

SEQ ID NO: 190 - DNA, 3452 bp, Homo sapiens
ggaagccgaaggctgctgcccggtggtcggctgagcggctctagcccagatctcagacggctgagtcactgcatcccggcgcggcccgcagaagacgagcgccgctgccgccgcctcctcctcccgggctcccgggctctcggggtccggggcctttgcacctgtcttttccagctgggcacaaagccttttgctgtcgccgtggcgactggaggccttcacttttaatccccctcattttccagttcattctctgcttattttctggtcagtccgtgaccctgtaggcggcctctgaccggcgatcgatttgccgccctcagggcgctgggcggccggctgcctccgaagctggggcggcctccgcggtctccatggtaacggcctctccggcgtctccgcctggaggggaagatgcggcctgcctggcccgccgcctcgcccccggcctcacggtgggaccccgggcactgaggacggaggtcccgggcgccggcccgcggggcaacgggcactagctggagaaagagcagctcatggagaggctgagagaagcggttttcgcgtcctacccaaactgggagagtaaccttcagcagctggactcaccgattggttttccttcattttcagtgaaatcccattctctggctggagacacagatggcctcaaatgagagagatgctatatcgtggtaccaaaagaagattggagcctacgatcagcagatatgggaaaagtcaatcgaacagactcagattaagggtttgaaaaacaaaccgaaaaagatgggccacataaagccagacttgattgacgttgacttaatcagagggtcaacatttgccaaagcaaaacctgaaattccatggacatctctgactcggaaggggcttgttcgagttgtattttttccattgttcagcaattggtggattcaggttacctctttaagaatctttgtttggctgttactactttatttcatgcaagttatagcaattgtcttatatttgatgatgcctattgtgaacataagtgaagtacttggacccttgtgccttatgctactcatgggaactgtccactgtcaaattgtgtctactcagataacaagaccatcaggaaacaatggaaatcgaagaagaagaaaattacgaaaaactgtaaatggtgatgggagccgagaaaatggaaataactcctctgataaagtcagaggaatagaaactttggaatctgtacccattattggtggtttttgggagactatctttggcaacaggattaaaagagtaaaattaatatctaacaaagggactgaaactgacaatgacccaagttgtgtccatcctatcattaagaggagacaatgtcgaccagagattagaatgtggcaaacaagagagaaagcaaaattttcagatggagaaaagtgccgtagggaggcttttaggcgtttgggtaatggggtgtctgatgacctgtcaagtgaagaagatggtgaagcacggacacagatgatattattgcgtaggagtgtggaaggggcctcaagtgacaatggttgtgaagttaagaatagaaaatcaatactttcaaggcacctaaactctcaggtaaagaaaaccactacaaggtggtgtcatattgtgcgggattcagatagtctggctgaatcagaatttgaatcagcagccttcagccagggctctagatcgggtgtgagtggtggctctcgaagcctcaacatgtcaagaagagactcagaaagcacccgccatgactcggagactgaggacatgttatgggacgacctgctacatggcccagagtgccggtcatctgtcaccagtgacagtgagggggcccatgtgaatacccttcactcagggaccaaacgtgaccccaaagaggatgtttttcagcagaatcatttattctggcttcagaattcaagtccttcctctgatcgagttagtgcaataatctgggaggggaatgagtgcaaaaagatggatatgtctgtgttggaaataagtggcatcatcatgagcagggtcaatgcctatcagcaaggagtaggttatcagatgctgggaaatgttgtcactattggattagcattttttccattcttacatcgacttttccgtgagaagagccttgaccaactaaagtccatttcagctgaggagatcttgactctcttttgtggggcaccacctgttacacctattattgttttgtcgataattaatttttttgaaagattgtgtcttacttggatgttttttttcatgatgtgtgtggcagagagaacatataaacagagatttttatttgcaaaactcttcagccatattacttctgccaggaaagctaggaaatatgaaatacctcatttcagacttaagaaggtggagaatattaaaatatggttatcactgcgttcctatctaaagagacgggggccacagcgttcagttgatgtggttgtatcctcggttttcctactgacactttcgattgctttcatttgttgtgctcaggttctccaaggacataaaactttcctgaatgatgcttataactgggagtttttgatctgggaaacagctttactactttttttattgcgtctggcctcactggggtctgaaaccaataagaaatacagcaatgtttcaatattacttacagaacagattaatttatatcttaagatggaaaaaaagccaaataagaaagaacagcttactctagtaaacaatgtattaaagctgtccaccaagttgttgaaagagctggacacaccatttagactctatggactgacaatgaatcccttaatctacaatatcacaagagtagttatcctttctgctgtctcaggtgttataagtgatcttctaggatttaatataagactgtggaaaattaaatcataagctgagtaaatgcctggactctcccctggctggtatcaaaacttacctatcaaggaaagtgatgactgcagaaaccagtgagatacccacctgcttgttcacatgcacaggtgctctcagctctgccaaagcgaatgaatggtgtttccggaggagcaagtccttttccaactgggtgtgcatgctaaaaacctgtattttcatgcttttcaaacaacatgaatagtcagctgactaaagactgtgtgtgttgtggtaacacaaagacaattttgtaagtttgcgcttcagtactgtgacagttatgtttactggacatagtcttttgggcaactatgatagatgcccaaagcatgaagcaaatatcttttattggaaatatgcaaattcaatacttttccattatagtctatagaactggagatttcatttctctatcaaagagagatcaagcgaactattttaggttaaatccgaataaaagaactttactggagact

SEQ ID NO: 191 - DNA, 2936 bp, Homo sapiens
attgggaacctaagtgccaggcttgtgccaggccccagtctctgacctcatggagcccacagcccactggggaacagagattaagccatgaaacacgaaaatgagtgccacaaagactgaaatcccattctctggctggagacacagatggcctcaaatgagagagatgctatatcgtggtaccaaaagaagattggagcctacgatcagcagatatgggaaaagtcaatcgaacagactcagattaagggtttgaaaaacaaaccgaaaaagatgggccacataaagccagacttgattgacgttgacttaatcagagggtcaacatttgccaaagcaaaacctgaaattccatggacatctctgactcggaaggggcttgttcgagttgtattttttccattgttcagcaattggtggattcaggttacctctttaagaatctttgtttggctgttactactttatttcatgcaagttatagcaattgtcttatatttgatgatgcctattgtgaacataagtgaagtacttggacccttgtgccttatgctactcatgggaactgtccactgtcaaattgtgtctactcagataacaagaccatcaggaaacaatggaaatcgaagaagaagaaaattacgaaaaactgtaaatggtgatgggagccgagaaaatggaaataactcctctgataaagtcagaggaatagaaactttggaatctgtacccattattggtggtttttgggagactatctttggcaacaggattaaaagagtaaaattaatatctaacaaagggactgaaactgacaatgacccaagttgtgtccatcctatcattaagaggagacaatgtcgaccagagattagaatgtggcaaacaagagagaaagcaaaattttcagatggagaaaagtgccgtagggaggcttttaggcgtttgggtaatggggtgtctgatgacctgtcaagtgaagaagatggtgaagcacggacacagatgatattattgcgtaggagtgtggaaggggcctcaagtgacaatggttgtgaagttaagaatagaaaatcaatactttcaaggcacctaaactctcaggtaaagaaaaccactacaaggtggtgtcatattgtgcgggattcagatagtctggctgaatcagaatttgaatcagcagccttcagccagggctctagatcgggtgtgagtggtggctctcgaagcctcaacatgtcaagaagagactcagaaagcacccgccatgactcggagactgaggacatgttatgggacgacctgctacatggcccagagtgccggtcatctgtcaccagtgacagtgagggggcccatgtgaatacccttcactcagggaccaaacgtgaccccaaagaggatgtttttcagcagaatcatttattctggcttcagaattcaagtccttcctctgatcgagttagtgcaataatctgggaggggaatgagtgcaaaaagatggatatgtctgtgttggaaataagtggcatcatcatgagcagggtcaatgcctatcagcaaggagtaggttatcagatgctgggaaatgttgtcactattggattagcattttttccattcttacatcgacttttccgtgagaagagccttgaccaactaaagtccatttcagctgaggagatcttgactctcttttgtggggcaccacctgttacacctattattgttttgtcgataattaatttttttgaaagattgtgtcttacttggatgttttttttcatgatgtgtgtggcagagagaacatataaacagagatttttatttgcaaaactcttcagccatattacttctgccaggaaagctaggaaatatgaaatacctcatttcagacttaagaaggtggagaatattaaaatatggttatcactgcgttcctatctaaagagacgggggccacagcgttcagttgatgtggttgtatcctcggttttcctactgacactttcgattgctttcatttgttgtgctcaggttctccaaggacataaaactttcctgaatgatgcttataactgggagtttttgatctgggaaacagctttactactttttttattgcgtctggcctcactggggtctgaaaccaataagaaatacagcaatgtttcaatattacttacagaacagattaatttatatcttaagatggaaaaaaagccaaataagaaagaacagcttactctagtaaacaatgtattaaagctgtccaccaagttgttgaaagagctggacacaccatttagactctatggactgacaatgaatcccttaatctacaatatcacaagagtagttatcctttctgctgtctcaggtgttataagtgatcttctaggatttaatataagactgtggaaaattaaatcataagctgagtaaatgcctggactctcccctggctggtatcaaaacttacctatcaaggaaagtgatgactgcagaaaccagtgagatacccacctgcttgttcacatgcacaggtgctctcagctctgccaaagcgaatgaatggtgtttccggaggagcaagtccttttccaactgggtgtgcatgctaaaaacctgtattttcatgcttttcaaacaacatgaatagtcagctgactaaagactgtgtgtgttgtggtaacacaaagacaattttgtaagtttgcgcttcagtactgtgacagttatgtttactggacatagtcttttgggcaactatgatagatgcccaaagcatgaagcaaatatcttttattggaaatatgcaaattcaatacttttccattatagtctatagaactggagatttcatttctctatcaaagagagatcaagcgaactattttaggttaaatccgaataaaagaactttactggagact

SEQ ID NO: 192 - DNA, 2989 bp, Homo sapiens
ataaactgggtgacagagtcagaaaactccccagctaaacacccgtaagacttcatacaacacaatactctatactgtgatgatcacagctgccaaggctacctaaaagaagacagttatctcatatttggctgccagctttttatctttctctcgaccacttaaaacttcagacttcctgtcctgctggtatcatggagaaagtccaatacctcactcgctcagctataagaagagcctcaaccattgaaatgcctcaacaagcacgtcaaaagctacagaatctatttatcaatttctgtctcatcttaatatgtctcttgctgatctgtatcatcgtgatgcttctctgaagttctgctacaacctctagatctgcagcttgccacatcagcttaaaatctgtcatcccatgcagacaggaaaacaatattgtataacagaccacttcctgagtagaagagtttctttgtgaaaaggtcaagattaagactaaaacttattgttaccatatgtattcatctgttggatcttgtaaacatgaaaagggctttattttcaaaaattaacttcaaaataagtgtataaaatgcaactgttgatttcctcaacatggctcacaaatttctatcccaaatcttttctgaagatgaagagtttagttttaaaactgcactgccaacaagttcacttcatatataaagcattatttttactcttttgaggtgaatataatttatattacaatgtaaaagcttctttaatactaagtatttttcaggtcttcaccaagtatcaaagtaataacacaaatgaagtgtcattattcaaaatagtccactgactcctcacatctgttatcttattataaagaactatttgtagtaactatcagaatctacattctaaaacagaaattgtattttttctatgccacattaacatcttttaaagttgatgagaatcaagtatggaaaagtaaggccatactcttacataataaaattccttttaagtaattttttcaaagaatcacagaattctagtacatgtaggtaaatcataaatctgttctaagacatatgatcaacagatgagaactggtggttaatatgtgacagtgagattagtcatatcactaatatactaacaacagaatctaatcttcatttaaggcactgtagtgaattatctgagctagagttacctagcttaccatactatatctttggaatcatgaaaccttaagacttcagaatgattttgcaggttgtcttccattccagcctaacatccaatgcaggcaaggaaaataaaagatttccagtgacagaaaaatatattatctcaagtattttttaaaaatatatgaattctctctccaaatattaactaattattagattatattttgaaatgaacttgttggcccatctattacatctacagctgacccttgaacatgggggttaggggagctgacaattcgtgggtccgcaaaatcttaactacctaatagcctactattgaccataaaccttactgataacataaacagtaaattaacacatattttgcgtgttatatgtattatacactatattcctacaataaagtaagctagagaaaatgttatttagaaaatcataagaaagagaaaatatatttactattcattaaatggaagtgggtcaacataaaagtcttcattctcattgtcttcacattgagtaggcagaggaggagaaagatggggaggaagagaaggcgttggtcttgcagtcttgtcttaggggtgtggggagtgggggaaagaatattcatgtataagtggacccttgcaattcaagcccttgttgttcaagggtcaactgtaataggatatagctatttttcttcctctatcaaccaaatggtaagcatctattttgcagtccactctactgagctaaattatagatccagctatgctatttataattattttcttgatgaataaattttcaatttctcctctgaccatttcagaacatcttccaataactcataaaacaactgaagtaaaattgagtgctggaaaatatattcaccaaactttggtaatttaagttgactaaagtttaaaattaagtctaaaatagtttacacctatactgcataatccaacaattttaatttcagttgaagacatgttactaatataactattattaaaagagtagaggatgtgtaattaaccatatcttctaaaacatggttactaaaagaatatgtaacatcaatattgaccttggtttcttacacaagtgttgctaactcaatagtgaaggagacactattaaattttctgaacccatgagagatactagagatggggagtggaaagtgtttggttcagggatatctgaagaacagaagggcagagatttcttaagtgacgcctcatctacaagctggaaattcctaaaaacaagtagaaagcttataaacaacaggtgatacactcacctcactggttttagtaaattaccaatacagaaagtatccctagtcttaaaaacaagtggaaaatttgaactgattagtcatattcctttgattacactgtttgttacaatatttttctcagtaaacagaaataactaatttttttgttcttcattctttgatagaaattaaaatcttattctgtgaggattacagaatactataactcaaattataaagtagaataaactctttaaataattattcttcatcataaagtgtaaagaataagatataagaaaacaatttatttttaaaatttaatatactaaatgctcaaatatgttctactatagaataagttcttatcttaatttacagggcactaaaaacaattttaaaatgcttaatgttgccttttatattttaattggttaagaatatatatttgtttaatgcaaatcagaatcactatattaaaatgaatgttcttgaaaactca

SEQ ID NO: 193 - DNA, 706 bp, Homo sapiens
aatctggttgagagcggcaataatccagaatggctactctgatctatgttgataaggaaaacgaagaaccaggcatccttgtggctacaaaggatgggctgaagctggggtctggaccttcaatcaaagccttagatgggagatctcaagtttcaatatcatgttttggcaaaacattcgatgctcccacatccttacctaaagctaccagaaaggctttgggaactgtcaacagagctacagaaaagtcagtaaagaccaatggacccctcaaacaaaaacagccaagcttttctgccaaaaagatgactgagaagactgttaaagcaaaaaactctgttcctgcctcagatgatggctatccagaaatagaaaaattatttcccttcaatcctctaggcttcgagagttttgacctgcctgaagagcaccagattgcacatctccccttgagtgaagtgcctctcatgatacttgatgaggagagagagcttgaaaagctgtttcagctgggccccccttcacctttgaagatgccctctccaccatggaaatccaatctgttgcagtctcctttaagcattctgttgaccctggatgttgaattgccacctgtttgctctgacatagatatttaaatttcttagtgctttagagtttgtgtatatttctattaataaagcattatttgtttaacagaaaaaaa

SEQ ID NO: 194 - DNA, 2253 bp, Homo sapiens
atctaatgaggagcgaggtgcggtgccccgaagcgctcgcttcccgcggtgcgatctagtcctgcagtaggcggcccggggccacaccgcggccgcccaagccagtgcaaggcccaggggcctgacatcgctcccagcgctcgaggaccgaggcctgctgtggaggacaccgtgctccctcgggacctgctctggattccggcccggacgtccccttggagctctgcatctccaacctggaacccaacccagaagtctcaagtttgacgcatcacgtggcgtgcggatccactgagggtccacagagaggggcgcccatctcctgcgtctcagttatcctggtgttgggaattctgtgccctaaagaattccgactcagatccgaacggggatctggtggaatcgagggtgaaagaccagagggacaatgttctactatcccaacgtgcttcagcgccacaccggctgctttgccaccatctggctggcggcgactcgcggcagccggttggtgaagcgcgaatacctgagggtgaatgtggtgaaaacctgcgaggaaatcctcaattacgtgctggtacgagtgcaacccccgcagcccggcctgccgcggccccgcttctccctctatctctcagcccaacttcagatcggtgtgatccgcgtctattctcaacaatgccagtacctcgtggaggacatccagcacatcttggagcgcctccaccgtgcccagctgcagatccgaatagatatggagactgagctacccagcctgctgcttcctaaccacctggccatgatggagaccctagaagatgctccagatcccttttttgggatgatgtctgtggatcccagacttcctagtcctttcgatatccctcagattcgacacctcttagaggctgcaatcccagagagagttgaagagatccctcctgaagttcctacagagcccagggagccagagaggattccggtcactgtgctgccacctgaggccatcacgatcctggaggcagagcccatacggatgctggagattgagggtgaacgggagctcccagaggtcagccgccgagaactggacctgctgatcgcagaggaagaagaagctatcttgttagaaatcccgcggctcccacctccagctcctgcagaggtggaaggaataggagaggcactgggtcctgaggagctgaggctgacaggctgggaacctggggccctactcatggaggtgacccccccggaggagctgcgtctgccagccccacccagcccagagaggaggcccccagtccccccacctcctcgccgccgccgtcgtcgccggttactgttctgggacaaggagactcagatctccccggagaaattccaggaacaactgcaaaccagagcccactgctgggaatgtcctatggtgcagccgcccgagaggaccatcagaggccctgcggagttgttcagaaccccaactctctctggctggctaccccctgaactactgggtctctggacccattgtgcccagccacccccaaaagccctcaggcgagagctgcctgaggaggcagccgctgaggaggaaaggagaaagattgaagttccaagtgagattgaggtcccgagggaggccctggagcccagtgttccccttatggtgtctttagagatctccctagaggcagctgaagaggagaagtcccgcatcagcctcatcccaccagaagaacggtgggcctggcctgaggtggaggcgccagaagctcctgcattgcccgtggtgcctgaactccctgaggtgcccatggagatgcctttggtgctgcccccagagctcgagctgctctcactggaagcagtgcacagggcagtggcactggagctgcaggctaacagggagcccgacttcagcagcctggtgtcacctctcagcccccgcaggatggctgcccgggtcttctacctgctcctggtgctctcagcgcaacagattcttcacgtgaaacaagaaaagccatatggtcgcctcctgatccagccggggcccagattccactgaggttagagtccatttacaaagctgccaggaaaccggccacttctagtaaaccacgtcgtgcctcactgggtcctgcttacctcatttctgaatgtgcatttccagccttcttgctctcagagctattgttcaagcagaaaacaagctgcttttattacagtaaaaaaaaaaaaaaaaaaaaa

SEQ ID NO: 195 - DNA, 2276 bp, Homo sapiens
ctagtcctgcagtaggcggcccggggccacaccgcggccgcccaagccagtgcaaggcccaggggcctgacatcgctcccagcgctcgaggaccgaggcctgctgtggaggacaccgtgctccctcgggacctgctctggattccggcccggacgtccccttggagctctgcatctccaacctggaacccaacccagaagtctcaagtttgacgcatcacgtggcgtgcggatccactgagggtccacagagaggggcgcccatctcctgcgtctcagttatcctggtaattgtgtatctgcccattgttcgttgcctcattaacttggctttctaggtgcacccaccttgccaccagagaagtccaaatcctgacttctctccaaggtgttgggaattctgtgccctaaagaattccgactcagatccgaacggggatctggtggaatcgagggtgaaagaccagagggacaatgttctactatcccaacgtgcttcagcgccacaccggctgctttgccaccatctggctggcggcgactcgcggcagccggttggtgaagcgcgaatacctgagggtgaatgtggtgaaaacctgcgaggaaatcctcaattacgtgctggtacgagtgcaacccccgcagcccggcctgccgcggccccgcttctccctctatctctcagcccaacttcagatcggtgtgatccgcgtctattctcaacaatgccagtacctcgtggaggacatccagcacatcttggagcgcctccaccgtgcccagctgcagatccgaatagatatggagactgagctacccagcctgctgcttcctaaccacctggccatgatggagaccctagaagatgctccagatcccttttttgggatgatgtctgtggatcccagacttcctagtcctttcgatatccctcagattcgacacctcttagaggctgcaatcccagagagagttgaagagatccctcctgaagttcctacagagcccagggagccagagaggattccggtcactgtgctgccacctgaggccatcacgatcctggaggcagagcccatacggatgctggagattgagggtgaacgggagctcccagaggtcagccgccgagaactggacctgctgatcgcagaggaagaagaagctatcttgttagaaatcccgcggctcccacctccagctcctgcagaggtggaaggaataggagaggcactgggtcctgaggagctgaggctgacaggctgggaacctggggccctactcatggaggtgacccccccggaggagctgcgtctgccagccccacccagcccagagaggaggcccccagtccccccacctcctcgccgccgccgtcgtcgccggttactgttctgggacaaggagactcagatctccccggagaaattccaggaacaactgcaaaccagagcccactgctgggaatgtcctatggtgcagccgcccgagaggaccatcagaggccctgcggagttgttcagaaccccaactctctctggctggctaccccctgaactactgggtctctggacccattgtgcccagccacccccaaaagccctcaggcgagagctgcctgaggaggcagccgctgaggaggaaaggagaaagattgaagttccaagtgagattgaggtcccgagggaggccctggagcccagtgttccccttatggtgtctttagagatctccctagaggcagctgaagaggagaagtcccgcatcagcctcatcccaccagaagaacggtgggcctggcctgaggtggaggcgccagaagctcctgcattgcccgtggtgcctgaactccctgaggtgcccatggagatgcctttggtgctgcccccagagctcgagctgctctcactggaagcagtgcacagggcagtggcactggagctgcaggctaacagggagcccgacttcagcagcctggtgtcacctctcagcccccgcaggatggctgcccgggtcttctacctgctcctggtgctctcagcgcaacagattcttcacgtgaaacaagaaaagccatatggtcgcctcctgatccagccggggcccagattccactgaggttagagtccatttacaaagctgccaggaaaccggccacttctagtaaaccacgtcgtgcctcactgggtcctgcttacctcatttctgaatgtgcatttccagccttcttgctctcagagctattgttcaagcagaaaacaagctgcttttattaca

SEQ ID NO: 196 - DNA, 7723 bp, Homo sapiens
atgccgctggcgcagctggcggacccgtggcagaagatggctgtggagagcccgtccgacagcgctgagaatggacagcaaattatggatgaacctatgggagaggaggagattaacccacaaactgaagaagtcagtatcaaagaaattgcaatcacacatcatgtaaaggaaggacatgaaaaggcagatccttcccagtttgaacttttaaaagtattagggcagggatcatttggaaaggttttcttagttaaaaaaatctcaggctctgatgctaggcagctttatgccatgaaggtattgaagaaggccacactgaaagttcgagaccgagttcggacaaaaatggaacgtgatatcttggtagaggttaatcatccttttattgtcaagttgcattatgcttttcaaactgaagggaagttgtatcttattttggattttctcaggggaggagatttgtttacacgcttatccaaagaggtgatgttcacagaagaagatgtcaaattctacttggctgaacttgcacttgctttagaccatctacatagcctgggaataatttatagagacttaaaaccagaaaatatacttcttgatgaagaaggtcacatcaagttaacagatttcggcctaagtaaagagtctattgaccatgaaaagaaggcatattctttttgtggaactgtggagtatatggctccagaagtagttaatcgtcgaggtcatactcagagtgctgactggtggtcttttggtgtgttaatgtttgaaatgcttactggtacactccctttccaaggaaaagatcgaaaagaaacaatgactatgattcttaaagccaaacttggaatgccacagtttttgagtcctgaagcgcagagtcttttacgaatgcttttcaagcgaaatcctgcaaacagattaggtgcaggaccagatggagttgaagaaattaaaagacattcatttttctcaacgatagactggaataaactgtatagaagagaaattcatccgccatttaaacctgcaacgggcaggcctgaagatacattctattttgatcctgagtttactgcaaaaactcccaaagattcacctggcattccacctagtgctaatgcacatcagctttttcgggggtttagttttgttgctattacctcagatgatgaaagccaagctatgcagacagttggtgtacattcaattgttcagcagttacacaggaacagtattcagtttactgatggatatgaagtaaaagaagatattggagttggctcctactctgtttgcaagagatgtatacataaagctacaaacatggagtttgcagtgaagattattgataaaagcaagagagacccaacagaagaaattgaaattcttcttcgttatggacagcatccaaacattatcactctaaaggatgtatatgatgatggaaagtatgtgtatgtagtaacagaacttatgaaaggaggtgaattgctggataaaattcttagacaaaaatttttctctgaacgagaggccagtgctgtcctgttcactataactaaaaccgttgaatatcttcacgcacaaggggtggttcatagagacttgaaacctagcaacattctttatgtggatgaatctggtaatccggaatctattcgaatttgtgattttggctttgcaaaacagctgagagcggaaaatggtcttctcatgactccttgttacactgcaaattttgttgcaccagaggttttaaaaagacaaggctatgatgctgcttgtgatatatggagtcttggtgtcctactctatacaatgcttaccggttacactccatttgcaaatggtcctgatgatacaccagaggaaatattggcacgaataggtagcggaaaattctcactcagtggtggttactggaattctgtttcagacacagcaaaggacctggtgtcaaagatgcttcatgtagaccctcatcagagactgactgctgctcttgtgctcagacatccttggatcgtccactgggaccaactgccacaataccaactaaacagacaggatgcaccacatctagtaaagggtgccatggcagctacatattctgctttgaaccgtaatcagtcaccagttttggaaccagtaggccgctctactcttgctcagcggagaggtattaaaaaaatcacctcaacagccctgtgaagtgacctcagtgagatatttggtaccatggtgtaagctgatagcacaagttctggcgacaggtagcacgtatctgagagacacctgcaagcacacactgtcccagctggtacccataatgctgctgttcctgctgctgctcctgctttcctctcttctcgctttaaatgattgttagcaagttagattttcctggagcttcggaagaaatgaaaatggaaacatgatgaagatatagtcactgaatcaatgagaaaaataatgaacatatgaataccacctaaaaatacactgaataaagtacaccatatagcattatttttataggaaatatttcatgtcccttaaatattctttgttagttatagggatggacagtttatgttaagcacttagcttaaacaatccgtttatattagcactgtatcccttgtgccatccaacattttgtatgtttttgtaaacagttcatatacagtacatttctgtactgctttctttaatgtatacatgccttgtttaacttggaatctattattattaatcaattgactattaaatctggttaaatagttcacctggattaacagtattgttggacagtcctaaaaatggccagattgtggaacagctgttgaatgtaatacttccaaaatgtacatatctttccccacgtctgtttcactggttcgttcatttgtttgtttcttaaagtcaggtgctctgtcagactaacctagagagctgttatggtagagaaagttatcatatgtgtgtggcatgaaatcaagaatacacctatgaagttagtccatatactttgcaactccttagagtacttttttccttaattaaggaagtagtccttgcacttctaatcttacatagcatccatacttagaatttggcatatcatctgggattttgccaatatacgtcaaagccctttaagagtcatggtaaggagatgggtgaaggaaaatttagcaacaggtaattgaagtcctattggatatttcatgtttaaatagatattctatattaaacactaatttaaatgtaataaaggccaaaggcctctgtatgaaattggatttaaactttcttattttagggaataaaacattattgatcaaacagtatctgttctaacctaaaattataggtagggcaggctaagtgaacagcattgagtattttctgaatccctcatgataatttatagccacatactgcttcctttgacttcaggaatgatcagttttcataatggccactgggcctgcttagattgcagtattcattatctgcatctaatttggtagtttccacaatcgtatttgatgaaagaaacttcagtccccattattacctgtgtctttgccaagctgcctagcatacatcagtatgtaatgtaaaagacatatgagcaagaaaaaagtgatttaacttacctcatcaagaatgtgcccctacaggccgggcgcagtggctcacgcctgtaatcccagcattttgggaggccgaggcaggtggatcacctgaggtcaggagtttgagaccagcctggccaacatggtgaaaccccgtctctactaaaaaatacaaaaattagctgggcatggtggcgtgcacctgtaatcctagctactcaggaggctgaggcaggagaatcgcttgaacctgggaggtggtggttgcagtgagccaagatcacaccattgcactccagcctgggtgacagagtgagactctgtctcaagaaggaaaaaaaaaaaaaagaatgtactcatacagatttttgttagtcatcatgtaataagccatttatatcagaaaccttttttcctgccacagaagctttaaattttcccctaagagtacaaagccaagagagtgtggtttatctaaatgtcctgaaatccacttgtcattccttaatttctcctctatgcaattaaagagaaaggggaaatctataacatttcttttgcccaagtgacacaaaaatgattactgcatagaaatcaaatgtaagtttagcttctaaatgaaataatatataggagggatatcagaatgtctagatagagaaagtattttcaaattcttgaatatatggatgctattaaaagctgctttccattgcctggaaagagagcttttttccctcctctattcagtgtttcaaactttggtcatctcaaattattgtcacttttaaaatgttaatgtcattctgagcagaaatagatatattttcagatttttttacactgatgctactccgtaattgcttaggagtattgtccatcatagtattttagaactagaagtaaacacataaatccttataaattacccaatccaactttctcatattgcatgtagagaacctgagacacatatcaaagtctagaatccttaacttctccccattttgtttttttccgcctcatcacaccatgctgcctttccctcatatgatcaccaaccagtagctgagttcaaaaactacatatttcttgggcagtcctctactggtatgtgatgccaacttttatttctttcgaagataattgccttctttgcctagccaagcagccaattttattggagaaaagcaagttatatgttcacaaaatggaaggctttctacctaaatttatttcatctgtggtcctcttattctcttccattgcttttgacatacagtggaaaaacttggccaacgatgtgctctaaatatagtgcttgtgttgggttaacttttccattaatttctcaacatcaattattcaggcccctacagttgtggtattgaggcccctaaaggcttctgcctttcaccaattagtgctgccagttactgaggcttctcccaaaaggtatcagtccagtcttaaagatatttcattgtgaaagaagaaactaaactatcaggcctcttttacaaaatgagagattgaatttaagcttgtcaagcacgtactggaaggtatgaattacactaccatgtgttttgtatcttccctttcaagtgatgatgttaaatgaaggtaagtttttcatccttttttaatttttgttttttataaatcatttcagctttttctggtttatagaggtgtcttatttctaatgcaacagacccccaactttaacagatttgatatggatgcatttattcacaagcaaccccaaaagtccaaaaatgtaataattttgacaaggcccaaagttgagatgctatgaagcttgtgtgtgtgaaaagtcagttatgattgtctggagagaagctgtggtgtgtatgctgtagagtttccacatttcacatgcagtgtactccaaaaagcgggtttgggtcaaccatttcccatctctttttaagaagtgactgctgttggggccaggggacatcatgggaggtggggctgtccagttagctgtgccctgcaccttcagcccaggaaagatttgaacagagcaaaggcttcaagagagggcagaatgtattcggcagaaaagggactcaggtaagcccagcctgggatgagagcagaaaagcattcaagatttgcaggccttgctatggatgcgcttaatcaccatggaggccagcaatacccatctcagcatggctttgatattctctacttcctggcctttaaaaatgacctataatttttcagtttgctttactatattttataaagaaaattctatcttatggttgattgagcattgagacttatgaaggcattaggatagatagctcaggaatgtaaaggttcagaaaaggtctgttttctcagattaacaaatatgatggattccatggctgaccttggtgcttaaaccaggaggtttcaatctagtcctagagttgtgtccctctgaaaggcccaatgccatgtaactaactttaaactggatatatactttgagccttacttaattcacagataagttgacttaactcagtatttttatttcaattaatgaaaacagtcctcttttcaaccccaggttgcttacattttgctggtctccccaagtgaccattggtggagaccaattaatgaaggaatgaaattcactttattgggactgtggtattcaacagagccacacttaaccactttttccaatgaagaatctccagaatgataatgcccaaatatggatggccaagaagaatttgtatctacggtgtgctttatgtgtttttgacactgctgtattctgtgtgatcaagtgatttgcagctggttccaatgtgactgagtgttctcaaagatttctagtaactaagtcaacttaattttcttaagcctggtattactatcagcctcacatttaccactttgattctagttttttaactgttcataacagggcataccgagggttgggatgagagcctacttcctacctcttaaggcactttcctcattattttgccatataatcttgaactgcatgataagctgtttaaatgtccatgacttctcccagagcaactagcaaagtatatgacattttgaatagagattagtggaaaggaaaatgtagagatttaagttcagaggtacaaacctcaataaaacctccttagagcacataccatgagtagagtatatgtaaacgtatatgagaagagagtcgctataatagtcctctctaagtagattagttcattgtctaatggaagtgaacatctttactcctgttatcaccatagtactgaatgaactgtataatgagtttttcaaacaagtatttaaaatagaactttcacgtacaaagcaagggcataaagattttggtttgtgtttctgtaagtgtagtttaccatctaaagctttggtttttaattttaaaaaaagcttcaaggtattgccattccttagcatccttattgattatgggtgatgagtttttaactcttaaaatcatatacgtgtattagtttatcttaactgttgccctaagcaaaagggaaggtatacacctaagggatgtacttattttgcatttttggtcatgggtgggaatggggtgggtgcctacttaaatagtttttaaaaaagaaaaaaatcacaaatatttttctactgttatatatgatcttcctttatactagtttctctctagtaaggcatgccagaagcccaagataccatatcatgaattcttacatattgtaccttttgttggtggttaaatcgcatcagatgcttggcattgctgccataattataaaatgcttgtaaaggatcaaatatcactaaatactttaaattgttttacttaagagtctaatctgggaagttttcaaatcatactattaatgtgtaatctaagctcttcagatgtatccatgaataatcctggaacaatattgcttgtattcctgtcatagaacaggttttgtaatctttaaaagaaatgaaaatttatataataaagtttcaaatcaatgcaaaaaaaaaaaaaa

SEQ ID NO: 197 - DNA, 3975 bp, Strongylocentrotus purpuratus
acatgtactgcggagctgggacagcatcacttctaggtaaatccttgtcaatttcggggcgtgtcacatcggacctaccgtcgcccaaatcgtcttaactctgttaacgctctttcaatatgggcgttgtggaagccgtgctcgtatcgtgcttgttcctaggctcattgttgtgcctaacatctgcagccagtctcaagagcatcgatgacgatgcaacaaaatatattgaccagatcaaacggcaaattaatcaagatgtcctatcgaagcttcctttctgccagcgatatgacgggtctcgggggttccgttgcagtgacggtggttgtgtacgattgagggaggtttgtgatggcgcaccagactgtactgacgtcgtcgaaacggccgatgatgaggacccgacgtactggctagttaataatctggaagagccctgtagtacctaccagtgtgctggtggccaatgtatctcatgggaagcaacgtgtgatggtgaccctgaagactgtggctacactggggaggacgagagcgcagcactgtgcggggtgacatgccctggtgacgtcagaaggttccattgtgacaactcgatttgcattgaacgatccctgatctgcgacctccgctgtaattgtgacaactgcgatgacgaggctggctgtgcctcattcacacatacatgtgacgacgataagcagttcagatgtgatgacggtacttgtattcttaacgaacagctgtgtgatgggaagacggactgtaaatcgggcggagaggatgaagaaggctgtgtggatgaatatggatgccacattcgacgagagttttactgcgaagtgaactataaatgtcttcaacgtgatagacggtgtgatggtacggtggactgccccggtggagatgatgagaaggcgtgtggcctgaatacgtgcttcaaatatgagttccaatgcgccaagcgtaagtgcatcgagaaagaaaaacgatgtgacaatgttattgactgtccatcgccgggtgaagacgaattgggatgcagtcgagaatgcactgaggaagaattcaaatgccttgacggggaatgcatccctctctaccgggcctgcgatggttttgccttcgactgcaagtcttacttcggtgaggatgaggaggggtgtggtcagagagaatgtcctcaagactggtattcttgtttcaacggcaggtgtctcccggaaaactttaggtgcgatggcgaacctgattgcagctttggcgaagacgagaccaactgcgtagaaccgattatatcaccttgtgcacaagatgagtttagctgtggcaacagcatttgcatcgctgaatcacggcattgcaatggctacaatgactgctatgatggaatagatgaaaagaactgcaacatagagtcatgtcctacaggacaggttgattgtggcaacaactattgtgttgttggagccagatgtgatggagtatctgactgcagcaacggacaagacgaaagtggatgtccacctacaatagttacatgtcccgcagggcgtattgattgtggcactaactattgtgttgttggagccagatgtgatggagtatctgactgcagcaacggacaagacgaaagtggatgtccacctacaatagttacatgtcccgcagggcgtattgattgtggcactaactattgtgttgttggagccagatgtgatggagtatctgactgcagcaacggacaagacgaaagtggatgtccacctacaatagttacatgtcccgcagggcgtattgattgtggcaccaattattgtgttgttggagccagatgtgatggagtatctgactgcagcaacggacaagacgaaatcggatgtccaccaacaatagttacatgtccggcagggcgtgttgattgtggcaacaactactgtgtcgttggtagcaaatgtgatggagtatctgactgtagcaacggacaagacgaaagtggatgtccacctacaatagttacatgtcccccagggcgtatcgattgtggcaccgactattgtgttgttggagccagatgtgatggagtatctgactgcagcaacggacaagacgaaattggatgtccacctacaatagtaacatgtccggcagggcgtgttgattgtggcaacaactactgtgtcgttggtagcaaatgtgatggagtatctgactgcagcaatggacaagacgaaagtggatgtccacctacaacaagtgcatgtcctgaagggcgtgttgattgtggcaacaactactgtgtcgttggtagcaaatgtgatggagtatctgactgtagcaacggacaagacgaaagtggatgtccacctacaacaagtacatgtcctgaagggcgtgttgattgtggcaccgactattgtgtttttggagccagatgtgatggagtatctgactgcagcaacggacaagacgaaattggatgtccacctacaatagtaacatgtccggcagggcgtgttgattgtggcaacaactactgtgtcgttggtagcaaatgtgatggagtatctgactgcagcaatggacaagacgaaagtgaatgtccacctacaacaagtgcatgtcctgaagggcgtgttgattgtggcaacaactattgtgtcgttggtggcaaatgtgatggagtatctgactgcagcaacggacaagacgaaagtggatgtccacctacaatagttacatgtccggcagggcgtattgattgtggcaccaattattgtgttgttggagccagatgtgatggagtatctgactgcagcaacggacaagacgaaagtggatgtccacctgcaatagttacatgtccggcagggcgtgttgattgtggcaacaactactgtgtcgttggtagcaaatgtgatggagtatctgactgcagcaacggacaagacgaagagggctgttcattcagttgtagatctcgaggagactgtgaattctttggaactgaggctgtggaatctcttgagcaacgagtgacaaaattagaacaattagatttagagaacatactggttttagagaacatactggtttaccttcaagatcagattgactacctctttgcttcacagcaatattatgcacatggggctgatgacgaggaacaggtggatagtaatcatcttgatgaagcagatcttgatgaagcagatttttcaaattcaacatctaccaatgcatcagaagataccacattgtcagtgaatacatcagaaacggggtcgtcggaaacgaatactctgccaacaacttcagcagctgacaccaaggaacctgtagctcagcagtacgtcgagtctgcgtctgatacatcaacaggtaaagagtctgacacaacaacagttccagcaacaacatctaccaatgcatcagaagataccacattgtcagtgaatacatcagaaacggggtcgtcggaaacgaatactctgccaacaacttcagcagctgacaccaaggaacctgtagctcagcagtacgtcgagtctgcgtctgatacatcaacaagtctgttcttagttccagcaacagttccagcaacaacatctaccaatgcatcagaagataccacattgtcagtgaatacatcagaaacggggtcgtcggaaacgaatactctgccaacaacttcagcaccgaacaccaaggaacctgtagctcagcagtacgtcgagtctgcgtctgatacatcaacaggtaaagagtctgttccagcaacagttccagcatcatccaatgcaacagaagataccacattgacagtgaatacatcggcaccagggtcgtcggaaacgacatctctgacagcaacttcagcaccctttaatattataaaaagaatcttttaatttttgagcagaggttagggccttaaggataagcttaaagcccacaatggaaaaatccacc

SEQ ID NO: 198 - DNA, 3926 bp, Lytechinus variegatus
cgcgggaaggattcgaaaaaggacgttgcaatctatagttttgtcatttttttcggctgccattttcctctttgatcttagaagaaaatggcggctctcttccacgttctcattgctctacagtgcactatctccatcgttttaagtaagcctgttgaattgactgaaagttggaaaggctcacccaagaaacaaccgatttggagagatcaaccgatggacatcggcaatgagatcgaccttggcaagagaaatgcattcggaaattgcatgccaccgggatccgatgtccctgggttccggtgtgcaacgagtcaggaatgtatccctttgggtgaggtctgcgatggcgtcaatgattgcgacttcgatgcctacgacgagacggatgatgcgtgtatggtagtccaatgcgaaggattcctctgtaccgatgggtcgtgtctcctcgccgagttcgtgtgcgatggatcttacgattgcagtgatcgcatggatgaagaggaatgtagcatgaatcagtgcagcgctgatcgcttccaatgccggagtggacggtgtatcccaaccttctggcggtgtgatatgcttgaggactgccagggaggggaggacgagcgaggatgcgatgaacacgtttgtccgggggacgaatttcgctgtgacaccggctcttgtgtcatccgcctttgggtttgcgacggtcagagtgattgtccccatggcgaagatgagacagttggttgtaacgtcgttgtggactgtgatgacgaccagttccagtgtggagacgattcgtgtatacctaaaaattgggtctgtgatggagttgacaactgtcccttaggtgaagatgaaaaccaagattgttgcaagaagaaagagttccgctgccataccgggcaatgcatccctgaagagtggcgctgtgacggacgtattcgggactgtccttcgggagaggacgaggaggactgtggatgcggtccgaatgaattccagtgcgacagcgggacgtgcattctggataccaagttctgtgacaatgtgattgactgtgatgatggtgggtccgatgaatcaagatgtccaatcattgatcctatacctgtatgcaaagcagctgggacggtcaagtgtatgtatggacaggtgtgtgctgtagtatgcaatggcatcagagagtgtccagtgaatggtgaagacgaagttgggtgtccagtgacgaactgtcagccttcagagtttgaatgccgagacggtcagtgtttaccggcttcggatatatgtgacggatacccgcattgctccggaggggaagatgagattgaatgtcctctgactaactgcttagcatccgagtttgaatgccgagatggtcagtgtttaccggcttcggatatatgtgacggatacccgcattgctccggaggggaagacgagattgaatgtcctctgactaactgcttagcatccgagtttgaatgccgagatggtcagtgtttaccggcttcggatatatgtgacggatacccgcattgttccggaggggaagacgagattgaatgtcctctgactaactgcttagcatccgagtttgaatgccgagatggtcagtgtttaccggcttcggatatatgtgacggatacccgcattgttccgaaggggacgacgagattgaatgtcctctgactaactgcttagcatccgagtttgaatgccgagatggtcagtgtttaccggcttcggatatatgtgacggatacccgcattgttccgaaggggaagacgagattggatgtcctctgactaactgcttagcatccgagtttgaatgccgagatggtcagtgtttaccggcttcggatatatgtgacggatacccgcattgttccgaaggggaagacgagattgaatgtcctctgactaactgcttagcatccgagtttgaatgccgagatggtcagtgtttaccggcttcggatatatgtgacggctacccgcattgctccgaaggggaagacgagattgaatgtcctctgactaactgcttagcatccgagtttgaatgccgagatggtcagtgtttaccggcttcggatatatgtgacggatacccgcattgttccggaggggaagacgagattgaatgtcctctgactaactgcttagcatccgagtttgaatgccgagatggtcagtgtttaccggcttcgaatatatgtgacggatacccgcattgttccaagggggaagatgaaagcgattgttcgctaccaattgtaccaactgaatctccgtatcctgtaacgagcccactctccatcgtatgtggactgccattgttttttgagtgtccggatggtacctgcatatcacgtgacctcctctgtaacggaaagcccgactgtccatatagcgacgcagatgagcaacctggtaactgtcggatcgtttctacatgtgaacctgatgagtttgagtgtgacgatgggagttgtatatattcagcgcttgtctgcaatgatcgagctgattgtactgatgagtcagatgaagcagtagaacgatgcggatttaatctatgtaattctgaagatggtttcagatgtcgagacggatcttgtatacctctgtaccaagtgtgtaatgacgtcatcgattgtcctgatggaggggatgaggatgactgtgctgcaatatatactagaccaggcatatgtcccgtacatcccaacatcgcatacggaggaaacaatatctgcgtcgacaactgttttcaagatacagactgccccgaaccaatgaaatgttgtccggcgccctctgcgtgcggcctaacatgtaccaacgtcttccttccttcaaaccctttgacaggtttggcagagctggcaaattttgttgagactcttcgtgatggcctagatattatcaataatgaagttgcaatcctgacagacgatgtggatgatatagaaacacgactgaagagccttgagacagatacgcgtctactgagacaggatgtggatatcctcaagcaacaggcaacagcgggtgacagaccacaagcaccagtttatcctgcaccatatgaatcagagcctaccacacagaaagtggtagagagctatgtcaaaccttaccagccgcaagatgttcagccttacaaaccagaagacgtgcaaccgtatgaaccagtaaccaaacgacctaacgaaccggaagaaccttacgagtcttataaaccagaagaaccgcaatatgttcaaccttctgaaccacaatatgtcagaccttacacaccagaaaacgttataacctatgaacaagaaacacccttgtcttataaaccacaagacgaaccagaaaccgtccgaccttacatcccgccacaagacgttaaaccatacgagccagaaaccgttcgtccttatgaaccagaagatatccaaccctacgaaacagaaacagcccaaccttacgaaccaccacaagatgaccaaccctacaaaccacctcaagatattagaccttacgaaccaccacaagatgttagaccttacgaaccaccacaagatgttaggccttacgaaccacctcaggatacaagaccatacgaacctccacaggatacaagaccatacgaacctccacaggatacaagaccttacgaaccacctcaggatacaagaccatacgaacctccacaggatacgagaccttacgagccgccgcaagataataaaccttacgaaccacctcaagatgttagaccttacgaaccacctcaagatgttaggccttacgaaccgcctcaggatacaagaccttacgaaccacctcaggatacaagaccatacgaaccacctcaggatacaagaccatacgaacctccacaggatatgagaccttacgagcc

SEQ ID NO: 199 - DNA, 1425 bp, Homo sapiens
gggggcggggctgcctgcggaaggggccgtgcgcgtggggtcgctccgcagctgcgagttcatggcgtcccggtgctccgagccctacccggaggtctccagaatccctaccgtcaggggatgcaacggctccctgtctggtgccctctcctgctgcgaggactcggcccagggctcgggcccgcccaaggcccctacggtggccgagggtcccagctcctgccttcggcggaacgtgatcagcgagagggagcgcaggaagcggatgtcgttgagctgtgagcgtctgcgggccctgctgccccagttcgatggccggcgggaggacatggcctcggtcctggagatgtctgtgcagttcctgcggcttgccagcgccctggggcccagtcaggagcagcacgctattcttgcttcctccaaggaaatgtggcactcgttgcaggaggatgttttacagttgacgttgtcgagtcagattcaagcaggtgtgccagaccctgggacgggagcgtccagcgggactcgaaccccagatgtgaaggcgtttctggaaagtccttggtccctggatccagcgtcggccagcccagagcccgtgccgcacatccttgcgtcctccaggcagtgggaccccgcgagctgcacgtccctgggcacggacaagtgtgaggcactgttggggctgtgccaggtgcggggtgggctgccccctttctcagaaccttccagcctggtgccgtggcccccaggccggagtcttcctaaggctgtgaggccacccctgtcctggcctccgttctcgcagcagcagaccttgcccgtgatgagcggggaggcccttggctggctgggccaggctgggcccctggccatgggggctgcacctctgggggagccagccaaggaggaccccatgctggcgcaggaggccgggtctgcgttggggtctgatgtggacgatgggacgtccttcctgctgactgctggtcccagctcgtggccggggtctctggagggtcgaggaggcagtggccctgcatgggccccagctgagagcagtccactggatgttggagagccaggcttcctaggggaccctgagcttggctcccaggagctccaggacagccctctggagccgtggggcctggatgtggactgtgcaggcctggccctgaaggacgaggtggagagcatcttccctgacttctttgcctgctagcagccaggctgtggagaggaggcgggcggggccggtggatctggagccgtgtgtgtccctgtcgcgtgcttgggcattttattttgggtttgggttgcagctgcaccctaatttgagcgaggcttacaggctgtgagaagaggatagtgaatattaaagagggaaagcagttttcctggaggaagcaaaaaaaaaaaaaa

SEQ ID NO: 200 - DNA, 1997 bp, Homo sapiens
gggggcggggctgcctgcggaaggggccgtgcgcgtggggtcgctccgcagctgcgagttcatggcgtcccggtgctccgagccctacccggaggtctccagaatccctaccgtcaggggatgcaacggctccctgtctggtgccctctcctgctgcgaggactcggcccagggctcgggcccgcccaaggcccctacggtggccgagggtcccagctcctgccttcggcggaacgtgatcagcgagagggagcgcaggaagcggatgtcgttgagctgtgagcgtctgcgggccctgctgccccagttcgatggccggcgggaggacatggcctcggtcctggagatgtctgtgcagttcctgcggcttgccagcgccctggggcccagtcaggagcagcacgctattcttgcttcctccaaggaaatgtggcactcgttgcaggaggatgttttacagttgacgttgtcgagtcagattcaagcaggtgtgccagaccctgggacgggagcgtccagcgggactcgaaccccagatgtgaaggcgtttctggaaagtccttggtccctggatccagcgtcggccagcccagagcccgtgccgcacatccttgcgtcctccaggcagtgggaccccgcgagctgcacgtccctgggcacggacaagtgtgaggcactgttggggctgtgccaggtgcggggtgggctgccccctttctcagaaccttccagcctggtgccgtggcccccaggccggagtcttcctaaggctgtgaggccacccctgtcctggcctccgttctcgcagcagcagaccttgcccgtgatgagcggggaggcccttggctggctgggccaggctgggcccctggccatgggggctgcacctctgggggagccagccaaggaggaccccatgctggcgcaggaggccgggtctgcgttggggtctgatgtggacgatgggacgtccttcctgctgactgctggtcccagctcgtggccgggtgagtggggccctgggttcagggctggtccccccgcgtaagcacctgatatgagctggggaattgggactcaggcctagcgtgtgtcagggggccccagggtctgtgtctgagcccccgttttctccaccgttggtgcttagctgttgggccgtgtctggtattgagcgttataggtgatatgtgagtgtgtgagtgaacgtgatgtggacgagcctgcatgagagctggcggtgcttggagccctgtattcttccccttgaccctgtgtcagcgaggcccctggtccagcccgtgctggccggcaaaggtgtatggccctgtgacatggcgtgtgtccattccatttaggatttagtgtttgggagcccgttcctggttctggtccaacaggtgtcctgggtctggggccaccaggtatgagctcacccacctcatcacagcctctgtgcagcggggacagggcagggcagacggactgaggtgggagctctgttcctccgaccccacctgtctgcctcaagctcccagagcacctgcctgccctgccgatgtgtcctgtttgcttccagggtctctggagggtcgaggaggcagtggccctgcatgggccccagctgagagcagtccactggatgttggagagccaggcttcctaggggaccctgagcttggctcccaggagctccaggacagccctctggagccgtggggcctggatgtggactgtgcaggcctggccctgaaggacgaggtggagagcatcttccctgacttctttgcctgctagcagccaggctgtggagaggaggcgggcggggccggtggatctggagccgtgtgtgtccctgtcgcgtgcttgggcattttattttgggtttgggttgcagctgcaccctaatttgagcgaggcttacaggctgtgagaagaggatagtgaatattaaagagggaaagcagttttcctggaggaagcaaaaaaaaaaaaaa

SEQ ID NO: 201 - DNA, 2125 bp, Homo sapiens
gccccaggacccagcacgtgcgcagcggccatggcttcctcaattatctgccaggagcactgccagatctcgggccaggcaaaaatagacatcttattagttggagatgtcactgtgggctacctggctgatactgtacagaaactatttgcaaacatagcagaagtcaccatcaccatcagtgacacgaaggaggcagcagcgcttttggatgattgcatattcaacatggttctcttgaaggtgccttcttcactaagtgccgaggagctggaagccatcaagttaattagatttggcaaaaagaaaaatacacattcactgtttgtttttataatccctgaaaattttaaaggttgtatttcagggcatggaatggatattgctttaactgaaccactgacaatggaaaaaatgagtaatgtggtaaaatactggacaacatgtccctcaaacactgttaagactgaaaacgcaactgggcctgaagaacttggattgcccctgcagaggtcctacagcgaacacctgggatattttcctactgatctatttgcctgctctgaatctttaaggaatggcaatgggcttgaattaaatgcttcgttgtcagagttcgagaaaaacaaaaagatctctcttcttcattcaagcaaggaaaaactaagaagggaaagaatcaaatattgctgtgagcagctgcgtactctcttgccgtatgtaaaagggagaaagaatgatgcggcttcagttcttgaggcaacagttgattatgtgaaatatatccgggagaaaatctctccagccgttatggcccagattacagaagcacttcagagcaacatgaggttttgtaagaaacaacaaacacccattgagctgtctctcccaggcactgtcatggcacagcgggaaaacagtgtgatgagcacttactcccctgagagagggctccaattcctgactaatacgtgctggaatgggtgctccactcctgatgcagagagctccttggatgaagctgtgagagttccatcaagctccgcctcagagaatgctattggtgatccatataaaactcacatttccagtgcagcgctgtctctgaattccttgcatactgtcagatattattctaaagtcaccccttcctacgatgcaactgctgtaacaaatcagaacatttcaattcatttaccttcagccatgcccccggtctcaaagcttctccctcggcactgcacttctgggttgggccagacgtgcactacacatcccaactgtctgcaacagttttgggcgtattaaaagcacatgtttgaaattcacactctcaaccacctactgggcgcagtttgacaatctaggaaaagtggaacaaagaatgattttgaaagctccacccaaagacctaatatcaaaagagttggcatggtttggcttctgataaatgcactcaaagcttctgcagatagaaagaccagcagcgaaaaagctggccacacactgtcactcatcttcatacacacttggatccccgccagccagagagctacaagaacaaatggcctcagtgacctacactctcttttctcaaaaaatattccacaatttatgaaaaaagcatgctataaggaagatccatgtagacacgataaaatgattagattgggaaggtgtgttgataccttgtgtcactgagtacagatattacaacttgattcttatttttagtatccctgtgaattactgtcactcatttctaggtggtcttttccttatttgacattttagagagtttccttcttcattcaccatccaaactaagatatgcagagagatgctgaaagaggggtttacctcctcacttgacaactaatgaataaattgatgtgtgcttttgcatttcacaatcccttgagtgaaacgatggctaataggtaaatatttctttctggaccttaagttacagactagcaggttttttgtttttcatctcttcctccctatgggtattagaaaggacagttgaaaataagggggaaaaaggtttgttttatatttcactgaattgttcttatatgtaagttttattattaaataaaatactcagttttcaccctga

SEQ ID NO: 202 - DNA, 1936 bp, Homo sapiens
ttagtgcagggggcgggcccgggacgcagcggctgtggagctcctcctgctgggaggctgccccaggacccagcacgtgcgcagcggccatggcttcctcaattatctgccaggagcactgccagatctcgggccaggcaaaaatagacatcttattagttggagatgtcactgtgggctacctggctgatactgtacagaaactatttgcaaacatagcagaagtcaccatcaccatcagtgacacgaaggaggcagcagcgcttttggatgattgcatattcaacatggttctcttgaaggtgccttcttcactaagtgccgaggagctggaagccatcaagttaattagatttggcaaaaagaaaaatacacattcactgtttgtttttataatccctgaaaattttaaaggttgtatttcagggcatggaatggatattgctttaactgaaccactgacaatggaaaaaatgagtaatgtggtaaaatactggacaacatgtccctcaaacactgttaagactgaaaacgcaactgggcctgaagaacttggattgcccctgcagaggtcctacagcgaacacctgggatattttcctactgatctatttgcctgctctgaatctttaaggaatggcaatgggcttgaattaaatgcttcgttgtcagagttcgagaaaaacaaaaagatctctcttcttcattcaagcaaggaaaaactaagaaggctgtacaggaagcatagcagcttctgtttctggtgagccctcaggaagcttacaatcatggcaggaggcaaagtggagccaatgtgtcacatagcaagaggaggagcaagagagagagaaaggagaggccccaaactcttttaaaccaccagatcttgcatgaactgagtgagaactcactcatcaccaaggggatggcgctaagctaagccctagagtgcccccatgatttaacacctcccaccaggttccacctccaacattgggcatcacatttcaccataagatttggaggggacaaaacatccaagccacatcagttatcaacccagcattgttatttgttttgcttaaacagtaagctgtcgcccagttatctaatactgtacaacagattactctgaaacttggtagtggaaatcaacaaactgtttatcatatctcatgattttgtgagtcaccagtttgggcagagcttggctctgtgattcttctcagtgtggtgttaaccatggcactccgtgatgttcagccagcaaaactggcctgtctggagattccagcgcagcgtcatccacacatgtggtcttctggtgggtgtggctgcaggttgtgctcaaatgggctgttcttccctgtggtctcatcacttctccacatggtatctccagcaagctagaaggacctcttacatgaaggcttaggattccatgagaccagtgtgaaagctacatcttctgaaatgctggtcccagaactgtcatagagtcactctccagatatcttttgattaaagcaggcacaggccagtgaagattcaagaggagaggaaatggaccctgactctttgttggagaaataagtaattttcagtgactttaatcttaactcttatctttttaacccaaatttcagattcttgtttgcagtagaacaggctcttcactgtatacaagattttgtctgagttgcaaaaattctctccccatgaatttccctgtattaccatcttttgctcctgcatttccccactcagtcttggctgccacaatcaaagggacataaagtacaaggacacttttttcttgcctctgtagtagaaatcttagcagtatacagctgctctaggcctgtcaaataaatatatactattggtttttaaaacattaataaattagaaaactaccctttaatgtatgccacca

SEQ ID NO: 203 - DNA, 1394 bp, Homo sapiens
ttaaggaggtgcagtcttatgggagggacaggggcggagtcagtctttaaaagctgttcccaggtctggcccgcctgccacaaacgctgagcccaggtgggagaggtctggcctatccgcgcctggcagctgtcggaactccggagaccacaaaggggtttatggtttaccccctccacggaaggtcggtctgatcgcagctgcgggtcggggagagggaccgggggtcccccagtcagtaggcctcagaacacctcttcagtgccggggcaccagacagcggattttgcattcgactctccccaaagtgtgccgaacaggttggaagcaaaggctccggtttaagctctgggcttggggataaaatacactttttaaggacccaagttcctcggcaacgactccagactgggaagacctttccattttcaggatcgacgcttcacgttgaggggagggcattcaggacgccctcttaaggcttctcccaacccatggcgctaccaggctcctcacaggaccaggcctggagcctggagcctccggctgccacggctgctgcctcctcatcttcgggaccccaggagcgggagggcgctgggagccccgcggcccccgggacgctgcccctggagaaggtgaagcggccgatgaacgcgttcatggtgtggagctccgctcagcgccgccagatggcgcagcagaaccccaagatgcacaactccgagatctccaagcgcctgggcgcgcagtggaagctgctggacgaggacgagaagcggcccttcgtggaggaggccaagcggctccgcgcccgacacctgcgcgactaccccgactacaagtaccggcctcggcgcaaggccaagagctcgggcgccggaccttcccgctgcggacagggaagaggcaacctggccagcggcggcccgctctgggggccggggtacgcgaccacccaaccgagcagaggctttgggtacagaccccccagctactcgacagcctacctgcctggcagctatggctcttcccactgcaaactggaagccccctcaccgtgctccctccctcagagtgaccctaggctccagggggaactgctgcccacctatacccactacctgccccctggctctcccactccatacaaccctccccttgctggtgcccccatgcccctaacccacctctaaccctcatggacgcagacctcacgggacgggcctcatcctccttttttaatccagcagcatcccctaccccaggctgtcaaccctttctcctgttggactacagttcagaggcagcctgcagtcctcccatgatagccagggagagccgcacaacatacaattatatttttggtagtattaaacagttttgtattattc

SEQ ID NO: 204 - DNA, 3283 bp, Homo sapiens
attgtcgcagctccgggtgggggagggatgactaaagacaacggctgtaagagaactccacaagagagtcagaacgaaaatgtgcaacaagtgcggcggctcctaccatggcaggtgattcgaggactcagcacgaggcgagagtagggaccaggaagagccggaaaacccgcctgtgattggccgtccacgggtatcggtcgttgtgattgggtgaggcccagacagacagctgcgttttgaaccgcgtagggttctgggtagcaaaggccttgcaaggctcttaaccgaaagggggagggggaaggtcgccaacaaacggctgagctcacaatcctggccggggcgtccccctcccccatggagagagccagacccgagccgccgcctcagccgcgcccgttgcgtcccgctccgcccccgctgccggtcgagggcacctccttttgggcagcagccatggagccccctccgtcgtctcccacactgagcgcggcagccagtgcgaccttggcctcgtcgtgcggggaggcagtggcgtccggcttacagcccgcggtgcggcggctgctgcaggtgaagccagagcaggtgttgctgctaccacagcctcaggcccagaacgaggaagccgctgcctcgtccgcgcaggcgcggctgttgcagttcaggcccgacctgcggctcctgcagccgccgacagcgtcagacggcgccacctccaggcccgagttgcacccggtgcagcccctggcgctgcatgtcaaggccaagaagcagaagctggggcccagcctggatcagtcagtggggcctcgaggggccgtcgaaaccggtcctagagcctccagggtggtcaagttggaaggccccgggccggccctcggctacttccgaggggacgagaagggcaagctggaggcggaggaggtcatgagagactcgatgcaaggcggggcaggcaaaagcccggcagccatccgagaaggtgtgatcaaaacggaggaacccgagagactcctcgaggactgcaggctcggcgcggagcccgcgtccaatggcctggttcatggcagcgcggaggtcatcttggccccaacgtccggtgcctttgggccgcaccagcaagaccttaggatccctttgacgctccacacggtcccccctggggcccggatccagtttcagggagctccgccttcagagctgataagattgaccaaggtccccctgacaccagtgcctactaaaatgcagtccctactggagccttctgtaaaaattgaaaccaaagatgtcccgctcaccgtgttgccctcagatgcaggcataccagatactcccttcagtaaggacagaaatggtcatgtgaagcgacccatgaacgcatttatggtttgggcaaggatccaccgaccagcactagccaaagctaacccagcagccaacaatgcagaaatcagtgtccagcttgggttagagtggaacaaacttagtgaagaacaaaagaaaccctattacgatgaagcacaaaagattaaggaaaagcacagagaggaatttcctggttgggtttatcagcctcgtccagggaagcgaaaacgattccctctaagtgtttccaatgtattttctggtaccacacagaatatcatctctacaaatcctacaacagtttatccttaccgctcacctacgtactctgtggtaattcccagcctacagaatcccatcactcatccagttggtgaaacctcacctgctatccagctgcccacacctgcagtccagagcccaagccctgtcacacttttccagcccagcgtctccagtgctgctcaggtggctgtccaggatccaagtctacctgtctatccagcactcccaccccaacgctttactgggccttcccaaacagacactcatcagctgcattctgaagccactcacactgtgaagcaacccactcctgtctctctagagagcgccaacaggatttcaagtagtgcaagtactgcccatgccagatttgcaacttcgaccatccaacctcctagggagtattccagcgtttccccttgtcccagaagtgctccaatcccccaggcttctcccattccacacccacatgtctaccagccccctccccttggccatccagccacactgttcgggacaccaccaagattctcttttcatcacccttacttcctacccggacctcactacttcccatcaagtacatgcccttacagtcggcctccctttggctatggaaattttccgagttcaatgccagaatgccttagttattatgaagacaggtacccaaaacatgagggtatcttttcaactttaaatagagactattcttttagagactactcaagtgaatgcacacacagtgaaaattctcggagttgtgagaacatgaatggaacttcttactataacagtcatagccacagtggggaagaaaacttaaaccctgtgcctcagctggacattggaaccttggagaatgtcttcacagccccgacatcaactccttctagcatccagcaagtcaatgtcaccgacagtgatgaggaggaagaagaaaaagtgctcagggatttataattttaaaacaaatatgcacagaaaataaacatttcttaaaatatattctgggtcagttggtatgagaaaaaaaaaagcctagaattctttgttgaaagttttcagtcgtgatttgaggagttaaaaccaaatgcaatttatgtcttcataaaattttgattagtgaaactagagtctggatgtttcattgtaggaatatttaagttattaagtagtttaattttaatggctgaaatttgcatcaacatgtattattattactttatcctggaacatgcaaaatactgaagcctcacagttgtatgtgaggggaaaggggaaataaatctagcatagtgtgatttttattttatctcaggatacattttttaaatgattttttgtttgctttttatgtaatacttatggatgttgtcaatttttgatgtaacattttgaaagtattttgacaactcctagtgaacttggacttggttgctaaatttaacttacactaataaccaattataagttccaaatgtgttttaatggcacctgggtgattcttcagctaaatttagtcatttctgtttctaaatatttttatcattttaaaatattttttttccatttggcatacatcgttctttgttgtaattaaataaacatagataaaattgtt

SEQ ID NO: 205 - DNA, 2787 bp, Homo sapiens
gggggagggatgactaaagacaacggctgtaagagaactccacaagagagtcagaacgaaaatgtgcaacaagtgcggcggctcctaccatggcaggtgattcgaggactcagcacgaggcgagagtagggaccaggaagagccggaaaacccgcctgtgattggccgtccacgggtatcggtcgttgtgattgggtgaggcccagacagacagctgcgttttgaaccgcgtagggttctgggtagcaaaggccttgcaaggctcttaaccgaaagggggagggggaaggtcgccaacaaacggctgagctcacaatcctggccggggcgtccccctcccccatggagagagccagacccgagccgccgcctcagccgcgcccgttgcgtcccgctccgcccccgctgccggtcgagggcacctccttttgggcagcagccatggagccccctccgtcgtctcccacactgagcgcggcagccagtgcgaccttggcctcgtcgtgcggggaggcagtggcgtccggcttacagcccgcggtgcggcggctgctgcaggtgaagccagagcaggtgttgctgctaccacagcctcaggcccagaacgaggaagccgctgcctcgtccgcgcaggcgcggctgttgcagttcaggcccgacctgcggctcctgcagccgccgacagcgtcagacggcgccacctccaggcccgagttgcacccggtgcagcccctggcgctgcatgtcaaggccaagaagcagaagctggggcccagcctggatcagtcagtggggcctcgaggggccgtcgaaaccggtcctagagcctccagggtggtcaagttggaaggccccgggccggccctcggctacttccgaggggacgagaagggcaagctggaggcggaggaggtcatgagagactcgatgcaaggcggggcaggcaaaagcccggcagccatccgagaaggtgtgatcaaaacggaggaacccgagagactcctcgaggactgcaggctcggcgcggagcccgcgtccaatggcctggttcatggcagcgcggaggtcatcttggccccaacgtccggtgcctttgggccgcaccagcaagaccttaggatccctttgacgctccacacggtcccccctggggcccggatccagtttcagggagctccgccttcagagctgataagattgaccaaggtccccctgacaccagtgcctactaaaatgcagtccctactggagccttctgtaaaaattgaaaccaaagatgtcccgctcaccgtgttgccctcagatgcaggcataccagatactcccttcagtaaggacagaaatggtcatgtgaagcgacccatgaacgcatttatggtttgggcaaggatccaccgaccagcactagccaaagctaacccagcagccaacaatgcagaaatcagtgtccagcttgggttagagtggaacaaacttagtgaagaacaaaagaaaccctattacgatgaagcacaaaagattaaggaaaagcacagagaggaatttcctggttgggtttatcagcctcgtccagggaagcgaaaacgattccctctaagtgtttccaatgtattttctggtaccacacagaatatcatctctacaaatcctacaacagtttatccttaccgctcacctacgtactctgtggtaattcccagcctacagaatcccatcactcatccagttgtacatgcccttacagtcggcctccctttggctatggaaattttccgagttcaatgccagaatgccttagttattatgaagacaggtacccaaaacatgagggtatcttttcaactttaaatagagactattcttttagagactactcaagtgaatgcacacacagtgaaaattctcggagttgtgagaacatgaatggaacttcttactataacagtcatagccacagtggggaagaaaacttaaaccctgtgcctcagctggacattggaaccttggagaatgtcttcacagccccgacatcaactccttctagcatccagcaagtcaatgtcaccgacagtgatgaggaggaagaagaaaaagtgctcagggatttataattttaaaacaaatatgcacagaaaataaacatttcttaaaatatattctgggtcagttggtatgagaaaaaaaaaagcctagaattctttgttgaaagttttcagtcgtgatttgaggagttaaaaccaaatgcaatttatgtcttcataaaattttgattagtgaaactagagtctggatgtttcattgtaggaatatttaagttattaagtagtttaattttaatggctgaaatttgcatcaacatgtattattattactttatcctggaacatgcaaaatactgaagcctcacagttgtatgtgaggggaaaggggaaataaatctagcatagtgtgatttttattttatctcaggatacattttttaaatgattttttgtttgctttttatgtaatacttatggatgttgtcaatttttgatgtaacattttgaaagtattttgacaactcctagtgaacttggacttggttgctaaatttaacttacactaataaccaattataagttccaaatgtgttttaatggcacctgggtgattcttcagctaaatttagtcatttctgtttctaaatatttttatcattttaaaatattttttttccatttggcatacatcgttctttgttgtaattaaataaacatagataaaattgttaaaaaaaaaaaaaaa

SEQ ID NO: 206 - DNA, 2177 bp, Homo sapiens
atattggctgcggggaaggggacgggggctgttggacatgcgtgcagagtccggcggccacggacgcggtaatattgtccctcggcatccgccgtggtgagacccggcgcgttgctgtgaagacggacgggtctggaagaagtggggtgcggtcatggagaaatgttgtagagggaaggaacaaagtctactgtgcatccagcaaggcataccagatactcccttcagtaaggacagaaatggtcatgtgaagcgacccatgaacgcatttatggtttgggcaaggatccaccgaccagcactagccaaagctaacccagcagccaacaatgcagaaatcagtgtccagcttgggttagagtggaacaaacttagtgaagaacaaaagaaaccctattacgatgaagcacaaaagattaaggaaaagcacagagaggaatttcctggttgggtttatcagcctcgtccagggaagcgaaaacgattccctctaagtgtttccaatgtattttctggtaccacacagaatatcatctctacaaatcctacaacagtttatccttaccgctcacctacgtactctgtggtaattcccagcctacagaatcccatcactcatccagttggtgaaacctcacctgctatccagctgcccacacctgcagtccagagcccaagccctgtcacacttttccagcccagcgtctccagtgctgctcaggtggctgtccaggatccaagtctacctgtctatccagcactcccaccccaacgctttactgggccttcccaaacagacactcatcagctgcattctgaagccactcacactgtgaagcaacccactcctgtctctctagagagcgccaacaggatttcaagtagtgcaagtactgcccatgccagatttgcaacttcgaccatccaacctcctagggagtattccagcgtttccccttgtcccagaagtgctccaatcccccaggcttctcccattccacacccacatgtctaccagccccctccccttggccatccagccacactgttcgggacaccaccaagattctcttttcatcacccttacttcctacccggacctcactacttcccatcaagtacatgcccttacagtcggcctccctttggctatggaaattttccgagttcaatgccagaatgccttagttattatgaagacaggtacccaaaacatgagggtatcttttcaactttaaatagagactattcttttagagactactcaagtgaatgcacacacagtgaaaattctcggagttgtgagaacatgaatggaacttcttactataacagtcatagccacagtggggaagaaaacttaaaccctgtgcctcagctggacattggaaccttggagaatgtcttcacagccccgacatcaactccttctagcatccagcaagtcaatgtcaccgacagtgatgaggaggaagaagaaaaagtgctcagggatttataattttaaaacaaatatgcacagaaaataaacatttcttaaaatatattctgggtcagttggtatgagaaaaaaaaaagcctagaattctttgttgaaagttttcagtcgtgatttgaggagttaaaaccaaatgcaatttatgtcttcataaaattttgattagtgaaactagagtctggatgtttcattgtaggaatatttaagttattaagtagtttaattttaatggctgaaatttgcatcaacatgtattattattactttatcctggaacatgcaaaatactgaagcctcacagttgtatgtgaggggaaaggggaaataaatctagcatagtgtgatttttattttatctcaggatacattttttaaatgattttttgtttgctttttatgtaatacttatggatgttgtcaatttttgatgtaacattttgaaagtattttgacaactcctagtgaacttggacttggttgctaaatttaacttacactaataaccaattataagttccaaatgtgttttaatggcacctgggtgattcttcagctaaatttagtcatttctgtttctaaatatttttatcattttaaaatattttttttccatttggcatacatcgttctttgttgtaattaaataaacatagataaaattgttaaaaaaaaaaaaaaa

SEQ ID NO: 207 - DNA, 1840 bp, Homo sapiens
ggcgtggcacgccgcccgctcagaaagcgcgggaaaggcacgcagccacgccccaagggcgcagcctaggacaggggcttctggagcttctggcagccgtctgccctcatggcctttgcacctatggggcccgaggcctcgttcttcgacgttttggaccgacacagggagtccctgctggctgccctgaggagaggtggcagggagcccccaactgggggaagccgcctggcctccagttctgaggttcttgcatctatagaaaatattatccaagacataatcacaagcttggcaagaaatgaagcacctgcattcacgatagacaacagatcaagctgggaaaacataaagtttgaagattctgtgggtcttcagatggtatcccattgcaccaccagaaagatcaaaagtgattcaccaaaatcagctcaaaaattttctctaatccttaaaatattgtccatgatttataaattagtacagagcaacacttatgcaaccaaaagggacatatattacactgacagtcaactctttggtaaccagactgtcgtcgacaatattatcaatgacatttcttgcatgttaaaagtgtcaaggaggagtctacatatattatctacatcaaaaggtttaattgctggcaacttaagatacatcgaggaagatggcaccaaagtgaattgtacctgtggtgcaacggctgttgctgtgccatcgaatattcaaggaattcggaatttagttacagatgcaaagtttgtattaattgtagaaaaagatgcaacatttcagcggctcctagatgacaacttttgcaacaaattgtctccttgcatcatgattacgggaaagggagttcctgatctaaacacaagacttttagtcaagaaactgtgggatacatttcatgttcctgttttcactcttgtagatgctgatccacatggcatagaaataatgtgcatctataagtatggatctatgtctatgtcttttgaagctcatcatctcacagttccagctattagatggcttggtcttctcccttctgatcttaaaagattaaatgtacctaaagatagtttgattccactgacaaaaagggaccaaatgaaacttgacagtatcctgaggagaccttatgttacctgccaaccattttggagaaaagaaatggaaataatggcagactctaaaatgaaggcagaaattcaagctttgactttcctatcatcagattatctttccagagtgtacttacctaacaaattaaaatttggaggatggatataaaaataaatcagaagaactctgattgccagaggcttttcattaattttgttttgattggcaaatactattgtggaaagaacatatattatattcttaattctgtaaaagtgaaataaaataactttccgttaattatatatttttgtcaaaacaaatgctgtactccaattttctttgcaaggccttattcttgcctctatagagacagatttctgtcctatcctctaaagcaaattataaaagaacatgttattttgacctttaaattatttttgaaaaaataatattttatacatgtcatcaaagtctacaaaatatttaccttctacgatacaactaatgttaacgcataaagtatcttactggtaacaaaaatcataatgatctgaatttgagatgttgcaaatgaattgtggtgtccggtagtttcttcttacattttcctttgcctttatactttaggggtcttactccattaattcatttgttacattagtaaaattcagtatgaataaatatttggactaaaaaaaaaaaaaaa

SEQ ID NO: 208 - DNA, 7680 bp, Homo sapiens
acccccccctccctgtccggtccgggttcgcttgcctcgtcagcgtccgcgtttttcccggccccccccaacccccccggacaggacccccttgagcttgtccctcagctgccaccatgagcgaccaagatcactccatggatgaaatgacagctgtggtgaaaattgaaaaaggagttggtggcaataatgggggcaatggtaatggtggtggtgccttttcacaggctcgaagtagcagcacaggcagtagcagcagcactggaggaggagggcaggagtcccagccatcccctttggctctgctggcagcaacttgcagcagaattgagtcacccaatgagaacagcaacaactcccagggcccgagtcagtcagggggaacaggtgagcttgacctcacagccacacaactttcacagggtgccaatggctggcagatcatctcttcctcctctggggctacccctacctcaaaggaacagagtggcagcagtaccaatggcagcaatggcagtgagtcttccaagaatcgcacagtctctggtgggcagtatgttgtggctgccgctcccaacttacagaaccagcaagttctgacaggactacctggagtgatgcctaatattcagtatcaagtaatcccacagttccagaccgttgatgggcaacagctgcagtttgctgccactggggcccaagtgcagcaggatggttctggtcaaatacagatcataccaggtgcaaaccaacagattatcacaaatcgaggaagtggaggcaacatcattgctgctatgccaaacctactccagcaggctgtccccctccaaggcctggctaataatgtactctcaggacagactcagtatgtgaccaatgtaccagtggccctgaatgggaacatcaccttgctacctgtcaacagcgtttctgcagctaccttgactcccagctctcaggcagtcacgatcagcagctctgggtcccaggagagtggctcacagcctgtcacctcagggactaccatcagttctgccagcttggtatcatcacaagccagttccagctcctttttcaccaatgccaatagctactcaactactactaccaccagcaacatgggaattatgaactttactaccagtggatcatcagggaccaactctcaaggccagacaccccagagggtcagtgggctacaggggtctgatgctctgaacatccagcaaaaccagacatctggaggctcattgcaagcaggccagcaaaaagaaggagagcaaaaccagcagacacagcagcaacaaattcttatccagcctcagctagttcaagggggacaggccctccaggccctccaagcagcaccattgtcagggcagacctttacaactcaagccatctcccaggaaaccctccagaacctccagcttcaggctgttccaaactctggtcccatcatcatccggacaccaacagtggggcccaatggacaggtcagttggcagactctacagctgcagaacctccaagttcagaacccacaagcccaaacaatcaccttagccccaatgcagggtgtttccttggggcagaccagcagcagcaacaccactctcacacccattgcctcagctgcttccattcctgctggcacagtcactgtgaatgctgctcaactctcctccatgccaggcctccagaccattaacctcagtgcattgggtacttcaggaatccaggtgcacccaattcaaggcctgccgttggctatagcaaatgccccaggtgatcatggagctcagcttggtctccatggggctggtggtgatggaatacatgatgacacagcaggtggagaggaaggagaaaacagcccagatgcccaaccccaagccggtcggaggacccggcgggaagcatgcacctgcccctactgtaaagacagtgaaggaaggggctcgggggatcctggcaaaaagaaacagcatatttgccacatccaaggctgtgggaaagtgtatggcaagacctctcacctgcgggcacacttgcgctggcatacaggcgagaggccatttatgtgtacctggtcatactgtgggaaacgcttcacacgttcggatgagctacagaggcacaaacgtacacacacaggtgagaagaaatttgcctgccctgagtgtcctaagcgcttcatgaggagtgaccacctgtcaaaacatatcaagacccaccagaataagaagggaggcccaggtgtagctctgagtgtgggcactttgcccctggacagtggggcaggttcagaaggcagtggcactgccactccttcagcccttattaccaccaatatggtagccatggaggccatctgtccagagggcattgcccgtcttgccaacagtggcatcaacgtcatgcaggtggcagatctgcagtccattaatatcagtggcaatggcttctgagatcaggcacccggggccagagacatatgggccataccccttaaccccgggatgcaaggtagcatgggtccaagagacatggaagagagagccatgaagcattaaaatgcatggtgttgagaagaatcaggagagggatacaagagaggagatggggtcccggcacccatctgtatcatcagtgcctctttgaaggtgggaaacattagtgaaaattctgttggtgccacgctttgatgagcatttgtttgaccccagtttcttcttacacttcttaccccagcctacccttcctgcatttctcttctcagctcttccatgatggattcccccccctttcctaaagccatcatgccttgataaatatatatgatcattgaaatactttttaacaaaaaacagattctatattattatatatatatatatatatataaagatatatagagatgcattcacaggggttggctgggaggaggaagaccattctgtgaccaaaataccttggtcattttttttatattgccttatttccctatggctgagccttgttgtgacacatcaagcttttctgtagatgttgtcttggcttcccaccagcttaagcgttcatatgctctgcttttagttcatatatacatacataatgtttttcctttcttaattttgtctttttgtttgggatcagcttcttgcactccttccctaactcaactgttgccgtctcatcttctctcatctgatcacttcatgttttgtttttgttactgcctggatgaggcacttctgtcaattttttcaggaccttagttccagcagcagaatggaaaaatccttgaagcccaggctgatgcttgaagtaactgtggagggagtgttcaaaatactactgacgcaggcaccttcttggcgctggagagtcaaaggcatctcccttcattagctgctctgagcatcaagaattagaagtctttcagtggaattgtacaagagtccctttgaagataataatcttggctcagtttgtataaactgtcaaattttcaaataataggtagggggctttcactaggaaaatcatgtgctcagaagaggaaatgactcgtagtcaggttcaggagttagtggagtatttggactttggtactgctgtcttccaaggtagctctaagttttgatgtgtgggcttctgagtttatattctgaaaggaaatacacttcttttgaacatccccactaggttcttttccattgtcaataaggagcatcagccagtgaatctgtttcaggtttccattctgcagaactcctccaaagcatgtgctagtggcaagacagtggttcttatgatgttttcccttaacttttccttgtatgttcttgggtggttcctaagggaaagggaagcacatgatcatgggaatgatagcccagaacaaaaagaaatcttgtcttaccacagtgttttataggagagattgggagaaatcatcctgttttctctgtgacctgatttcagaagagactgatccaaaaattataacggcagggaacctagtgcatttggcactgagatttaaatgcaaccagaattgtcctcaaggcccagccataaaagcattgtctctctcgaccttctggtatcttgttagagagcttttcactgtgaggaagtgtggaaaaatagctctgtgtgtgtgtgtgtgtgtgtgtgtgtgtgtgtgtgtaatctgttaggttggggataggttttctgctagccaatattaaaagagacctgcaataaaaaaattaccctgatctgatagaaagcaagtgtttttgtatgtgtgggtgaatgtgtgttcatgcccgtatatgtctacacacagatgacaaattatatttgaaatcgttggaaaataaattcagatcaaaatgcctttcaggcccattacctagaaatctatcttaaaacctgggtatgttcctaaggtcatttctttgcttatgctaaattaattacaattatgaatggaggatattctactgtacttttttaaaaagaaactatttttgtgtttgaaagtgaaaccaacatccagatctatagcagagtccttattcttctcataaatctttttactttggctacaaatagatgatggtatgattctattatatattttatataaaatccatccaaattaagttttgggtaagtgtgttgtttaatctgaactatagtaacttaatactctaaacaatagttcactccatttggtcctttctccacagatgtaattatgttttcaactcaggaactatggcaaggaactttccccagatcaaattctattaacgctgagatacaagtcatccatgcacagccactatcataccctttattctcactgaaaggcagaactcagaacctgttattttatgtctgtaatcatgtactttggcatcttttggaggaaaggggcaggataactcactggaatgtacagtattttgctagtgcatttcaaggaatggaatcttctccagtatgaaattaccagatataaaataatgtaatgatgctgaggatataagcttttagaaggtaatttgatggtatttctttctcgaatgaaaagctgctggtttaccctcaaccctattcattagcattaccatgagtgaatttatatctaattatttccacttgccctgttctcttcacaccaaggaagctccagatccagtatcttgtttggcctcaaaacagaagcagcttcttttgtctcccagcagtagtgagccactcagtctcttccacaggaagtttggagcctacattccttgagtcaggagcttattacagaaaaaccccgtttccctgaacttttggctaacagaaattaatttaactgacatgcatattgattctgaaatttttttcctaagtttttttcatttttttgaatgagttttttaaattttttagatgaccaaaacttgcagggcaggggatgcccagaagagtggtgagatagtaaaacacttattccctcatcctttcaggttttcaggttgcccatttatattcatttacatgtcatttgactgtctcactttttacccagaacagtaacaacccacaccgtcttccttcagggatttccaactggcactctgtgggtgctacacagaatgcaatttaatggatatttctcagcctggttcagaataaattgatcctttgatcccagaaagtatatactgaagtgtgggataaagattatgattaggggagggttggagacaaaagctgtaaattactatggctgatttatttctactatatacatatatattttttgcttttgtatatcctatataggaaactaagcattgtattttttttaacaaatctaaaaaagcactatgaactacaggtgtttgactttcaaaatatattttgtattgttaatatcttcacattgtgtgaatactggaagctgcagatctttgctaggacgcaataaatttatatactttttgaggggttcttctggggtgctaatcaggcccctgttatgcttagggggagccctggtgctacttgcttgaagttttcagtgtaagtaccctgatgccttttggaccttgggatcagatcaagagttttggagatcaggtaccaaggaaataaggacagtctagctgcctcaagtgaggggccctttgcatagctctccttccccctcactgaagctgggtagcctattggggttgagagggaaaatgtgaaatctcagaatttatctcccttagaagagagccagtaacttatgtacaaggatgaaagaaaggtcgcagcagtagctttggggaaagggaggaagatatggcacttctccaaccccggaaaacattgcttttgaaaactgctgataaaatatgagccggttattacttctgtttgggagactgtgctctctgtggtgcctctcttggctctactccacagataccagacctcttctaagaggatgagcagaccagctttgaggttgacctgtttctctttgtctgccttcccaaaacaccagcccccaggaagacattaagcagccttaagcttaaattcctactccctcttccaaatttggctcacttgccttagatccaaggcagggaaaggaaaagaaggggggtctctggctttattactcccctaagtctttactctgacttccccaaacccagaaagattttctccacagtgttcatttgaaagaggagtattttgtcccattttccccttcctcattatcaaacagccccagtcttccttgtctctgctaagaaagtagaggcatgatgatctgcctctcaactgccctaagtcctagctaagtatcaggggaaaaaaaaaaaaaaaaagcctaacaaatgggattagactagggctgcaagtagtgaggattttgttgatacctctgctgggatgtgtgctttcccatatcttgccttcaggaattacactgtgccttttccccagggatatgggctctgtctacccagtgctccagtttcccggtaactgctcttgaacattgtggacaagggcaggtcttcatatttttgatcatccctttctcccagtgaaatcccatagcccttacctagagtctagggcacaaagacttcggggaagatacactgagattgacctgaggagacatctacacacaccagtggcagctgccccagggcctgcttccccttcctaagtctgtcatcctctggaagggatgggtggtgctccaatctctggtgcctaaaaacccaagtttatttctctcttaacactggcaataaccagtccacaccactgttgccttttaaaacctcttaataatctcatgctgtgtttgttttgattccaatccaattatcaccagggctgtgtgggtaaatgcttttaaatgctctctcatcttgttcttccccctcaccccccactcttaggtatgtatgatgctaatcttgtccctaagtaagtttcttcctgctccttttgtatcttcctttcttgtctttcctcctaccttttgtctcttggtgttttgggacttttttttttttttttttggccttttgtacaaagattagtttcaatgtagtctgtagcctcctttgtaaaccaattaaaaagttttttaataaaaaa

SEQ ID NO: 209 - DNA, 7614 bp, Homo sapiens
aggccccgcccgggccaaccgcctgcctggtccgccctctgaccaagatcactccatggatgaaatgacagctgtggtgaaaattgaaaaaggagttggtggcaataatgggggcaatggtaatggtggtggtgccttttcacaggctcgaagtagcagcacaggcagtagcagcagcactggaggaggagggcaggagtcccagccatcccctttggctctgctggcagcaacttgcagcagaattgagtcacccaatgagaacagcaacaactcccagggcccgagtcagtcagggggaacaggtgagcttgacctcacagccacacaactttcacagggtgccaatggctggcagatcatctcttcctcctctggggctacccctacctcaaaggaacagagtggcagcagtaccaatggcagcaatggcagtgagtcttccaagaatcgcacagtctctggtgggcagtatgttgtggctgccgctcccaacttacagaaccagcaagttctgacaggactacctggagtgatgcctaatattcagtatcaagtaatcccacagttccagaccgttgatgggcaacagctgcagtttgctgccactggggcccaagtgcagcaggatggttctggtcaaatacagatcataccaggtgcaaaccaacagattatcacaaatcgaggaagtggaggcaacatcattgctgctatgccaaacctactccagcaggctgtccccctccaaggcctggctaataatgtactctcaggacagactcagtatgtgaccaatgtaccagtggccctgaatgggaacatcaccttgctacctgtcaacagcgtttctgcagctaccttgactcccagctctcaggcagtcacgatcagcagctctgggtcccaggagagtggctcacagcctgtcacctcagggactaccatcagttctgccagcttggtatcatcacaagccagttccagctcctttttcaccaatgccaatagctactcaactactactaccaccagcaacatgggaattatgaactttactaccagtggatcatcagggaccaactctcaaggccagacaccccagagggtcagtgggctacaggggtctgatgctctgaacatccagcaaaaccagacatctggaggctcattgcaagcaggccagcaaaaagaaggagagcaaaaccagcagacacagcagcaacaaattcttatccagcctcagctagttcaagggggacaggccctccaggccctccaagcagcaccattgtcagggcagacctttacaactcaagccatctcccaggaaaccctccagaacctccagcttcaggctgttccaaactctggtcccatcatcatccggacaccaacagtggggcccaatggacaggtcagttggcagactctacagctgcagaacctccaagttcagaacccacaagcccaaacaatcaccttagccccaatgcagggtgtttccttggggcagaccagcagcagcaacaccactctcacacccattgcctcagctgcttccattcctgctggcacagtcactgtgaatgctgctcaactctcctccatgccaggcctccagaccattaacctcagtgcattgggtacttcaggaatccaggtgcacccaattcaaggcctgccgttggctatagcaaatgccccaggtgatcatggagctcagcttggtctccatggggctggtggtgatggaatacatgatgacacagcaggtggagaggaaggagaaaacagcccagatgcccaaccccaagccggtcggaggacccggcgggaagcatgcacctgcccctactgtaaagacagtgaaggaaggggctcgggggatcctggcaaaaagaaacagcatatttgccacatccaaggctgtgggaaagtgtatggcaagacctctcacctgcgggcacacttgcgctggcatacaggcgagaggccatttatgtgtacctggtcatactgtgggaaacgcttcacacgttcggatgagctacagaggcacaaacgtacacacacaggtgagaagaaatttgcctgccctgagtgtcctaagcgcttcatgaggagtgaccacctgtcaaaacatatcaagacccaccagaataagaagggaggcccaggtgtagctctgagtgtgggcactttgcccctggacagtggggcaggttcagaaggcagtggcactgccactccttcagcccttattaccaccaatatggtagccatggaggccatctgtccagagggcattgcccgtcttgccaacagtggcatcaacgtcatgcaggtggcagatctgcagtccattaatatcagtggcaatggcttctgagatcaggcacccggggccagagacatatgggccataccccttaaccccgggatgcaaggtagcatgggtccaagagacatggaagagagagccatgaagcattaaaatgcatggtgttgagaagaatcaggagagggatacaagagaggagatggggtcccggcacccatctgtatcatcagtgcctctttgaaggtgggaaacattagtgaaaattctgttggtgccacgctttgatgagcatttgtttgaccccagtttcttcttacacttcttaccccagcctacccttcctgcatttctcttctcagctcttccatgatggattcccccccctttcctaaagccatcatgccttgataaatatatatgatcattgaaatactttttaacaaaaaacagattctatattattatatatatatatatatatataaagatatatagagatgcattcacaggggttggctgggaggaggaagaccattctgtgaccaaaataccttggtcattttttttatattgccttatttccctatggctgagccttgttgtgacacatcaagcttttctgtagatgttgtcttggcttcccaccagcttaagcgttcatatgctctgcttttagttcatatatacatacataatgtttttcctttcttaattttgtctttttgtttgggatcagcttcttgcactccttccctaactcaactgttgccgtctcatcttctctcatctgatcacttcatgttttgtttttgttactgcctggatgaggcacttctgtcaattttttcaggaccttagttccagcagcagaatggaaaaatccttgaagcccaggctgatgcttgaagtaactgtggagggagtgttcaaaatactactgacgcaggcaccttcttggcgctggagagtcaaaggcatctcccttcattagctgctctgagcatcaagaattagaagtctttcagtggaattgtacaagagtccctttgaagataataatcttggctcagtttgtataaactgtcaaattttcaaataataggtagggggctttcactaggaaaatcatgtgctcagaagaggaaatgactcgtagtcaggttcaggagttagtggagtatttggactttggtactgctgtcttccaaggtagctctaagttttgatgtgtgggcttctgagtttatattctgaaaggaaatacacttcttttgaacatccccactaggttcttttccattgtcaataaggagcatcagccagtgaatctgtttcaggtttccattctgcagaactcctccaaagcatgtgctagtggcaagacagtggttcttatgatgttttcccttaacttttccttgtatgttcttgggtggttcctaagggaaagggaagcacatgatcatgggaatgatagcccagaacaaaaagaaatcttgtcttaccacagtgttttataggagagattgggagaaatcatcctgttttctctgtgacctgatttcagaagagactgatccaaaaattataacggcagggaacctagtgcatttggcactgagatttaaatgcaaccagaattgtcctcaaggcccagccataaaagcattgtctctctcgaccttctggtatcttgttagagagcttttcactgtgaggaagtgtggaaaaatagctctgtgtgtgtgtgtgtgtgtgtgtgtgtgtgtgtgtgtaatctgttaggttggggataggttttctgctagccaatattaaaagagacctgcaataaaaaaattaccctgatctgatagaaagcaagtgtttttgtatgtgtgggtgaatgtgtgttcatgcccgtatatgtctacacacagatgacaaattatatttgaaatcgttggaaaataaattcagatcaaaatgcctttcaggcccattacctagaaatctatcttaaaacctgggtatgttcctaaggtcatttctttgcttatgctaaattaattacaattatgaatggaggatattctactgtacttttttaaaaagaaactatttttgtgtttgaaagtgaaaccaacatccagatctatagcagagtccttattcttctcataaatctttttactttggctacaaatagatgatggtatgattctattatatattttatataaaatccatccaaattaagttttgggtaagtgtgttgtttaatctgaactatagtaacttaatactctaaacaatagttcactccatttggtcctttctccacagatgtaattatgttttcaactcaggaactatggcaaggaactttccccagatcaaattctattaacgctgagatacaagtcatccatgcacagccactatcataccctttattctcactgaaaggcagaactcagaacctgttattttatgtctgtaatcatgtactttggcatcttttggaggaaaggggcaggataactcactggaatgtacagtattttgctagtgcatttcaaggaatggaatcttctccagtatgaaattaccagatataaaataatgtaatgatgctgaggatataagcttttagaaggtaatttgatggtatttctttctcgaatgaaaagctgctggtttaccctcaaccctattcattagcattaccatgagtgaatttatatctaattatttccacttgccctgttctcttcacaccaaggaagctccagatccagtatcttgtttggcctcaaaacagaagcagcttcttttgtctcccagcagtagtgagccactcagtctcttccacaggaagtttggagcctacattccttgagtcaggagcttattacagaaaaaccccgtttccctgaacttttggctaacagaaattaatttaactgacatgcatattgattctgaaatttttttcctaagtttttttcatttttttgaatgagttttttaaattttttagatgaccaaaacttgcagggcaggggatgcccagaagagtggtgagatagtaaaacacttattccctcatcctttcaggttttcaggttgcccatttatattcatttacatgtcatttgactgtctcactttttacccagaacagtaacaacccacaccgtcttccttcagggatttccaactggcactctgtgggtgctacacagaatgcaatttaatggatatttctcagcctggttcagaataaattgatcctttgatcccagaaagtatatactgaagtgtgggataaagattatgattaggggagggttggagacaaaagctgtaaattactatggctgatttatttctactatatacatatatattttttgcttttgtatatcctatataggaaactaagcattgtattttttttaacaaatctaaaaaagcactatgaactacaggtgtttgactttcaaaatatattttgtattgttaatatcttcacattgtgtgaatactggaagctgcagatctttgctaggacgcaataaatttatatactttttgaggggttcttctggggtgctaatcaggcccctgttatgcttagggggagccctggtgctacttgcttgaagttttcagtgtaagtaccctgatgccttttggaccttgggatcagatcaagagttttggagatcaggtaccaaggaaataaggacagtctagctgcctcaagtgaggggccctttgcatagctctccttccccctcactgaagctgggtagcctattggggttgagagggaaaatgtgaaatctcagaatttatctcccttagaagagagccagtaacttatgtacaaggatgaaagaaaggtcgcagcagtagctttggggaaagggaggaagatatggcacttctccaaccccggaaaacattgcttttgaaaactgctgataaaatatgagccggttattacttctgtttgggagactgtgctctctgtggtgcctctcttggctctactccacagataccagacctcttctaagaggatgagcagaccagctttgaggttgacctgtttctctttgtctgccttcccaaaacaccagcccccaggaagacattaagcagccttaagcttaaattcctactccctcttccaaatttggctcacttgccttagatccaaggcagggaaaggaaaagaaggggggtctctggctttattactcccctaagtctttactctgacttccccaaacccagaaagattttctccacagtgttcatttgaaagaggagtattttgtcccattttccccttcctcattatcaaacagccccagtcttccttgtctctgctaagaaagtagaggcatgatgatctgcctctcaactgccctaagtcctagctaagtatcaggggaaaaaaaaaaaaaaaaagcctaacaaatgggattagactagggctgcaagtagtgaggattttgttgatacctctgctgggatgtgtgctttcccatatcttgccttcaggaattacactgtgccttttccccagggatatgggctctgtctacccagtgctccagtttcccggtaactgctcttgaacattgtggacaagggcaggtcttcatatttttgatcatccctttctcccagtgaaatcccatagcccttacctagagtctagggcacaaagacttcggggaagatacactgagattgacctgaggagacatctacacacaccagtggcagctgccccagggcctgcttccccttcctaagtctgtcatcctctggaagggatgggtggtgctccaatctctggtgcctaaaaacccaagtttatttctctcttaacactggcaataaccagtccacaccactgttgccttttaaaacctcttaataatctcatgctgtgtttgttttgattccaatccaattatcaccagggctgtgtgggtaaatgcttttaaatgctctctcatcttgttcttccccctcaccccccactcttaggtatgtatgatgctaatcttgtccctaagtaagtttcttcctgctccttttgtatcttcctttcttgtctttcctcctaccttttgtctcttggtgttttgggacttttttttttttttttttggccttttgtacaaagattagtttcaatgtagtctgtagcctcctttgtaaaccaattaaaaagttttttaataaaaaaaaaaaaaaaaaaaaaa

SEQ ID NO: 210 - DNA, 6359 bp, Homo sapiens
gggacgaatttcctccccagctcagctcccctacagcttggctaggcctgctccgagcgcctgcaaggtggaggaggcctgcgcctcgggcctggcagcggcagccggcgagggaggcgggcacagcggggtaaccggcgagccgtagccgctctcgaaaacctacgctgccacggccgctcattgtctctccccttccacccgggggcaaacaggaagcgcgccgcctggcagaccgacggacaggcgcctggaccaatgagcacagccgacaaagagcacggcggcgaatgagagccaagaagaggggcgggagttccgggcgggctgtcaccctcttccccccttttgggctggaggctccaccttttgtgtttcccgcacagtcaatcaaaataggaaaaaaaaatccccggaccgctccggccgtgtccgccgccgcttcccgcatcctctcccgccgccgccgccttcgctcctcaccatgtgtaaggcggcggggagccccgcctgaggtgccctaaacacactatgaccgctcccgaaaagcccgtgaaacaagaggaaatggctgccttggacgtggatagcggcggcggcggtggcggcggcggcggccacggcgagtatctgcagcagcagcaacagcacggaaacggtgcggtggcggcggcagcggcggcccaggacactcagccgtcaccgctcgctctgctggccgctacctgcagcaagatagggccgccatcgccgggcgacgacgaggaggaggcggccgccgcagccggggcccccgccgccgccggagcgacaggtgatttggcttctgcacagttaggaggagcaccaaaccgatgggaggttttgtcagccacacctacaactataaaagatgaagctggtaatctagtccagattccaagtgctgctacttcaagtgggcagtatgttcttccccttcagaatttgcagaatcaacaaatattttccgttgcaccaggatcagattcatcaaatggtacagtgtccagtgttcaatatcaagtgataccacagatccagtcagcagatggtcagcaggttcaaattggtttcacaggctcttcagataatgggggtataaatcaagaaagcagtcaaattcagatcattcctggctctaatcaaaccttacttgcctctggaacaccttctgctaacatccagaatctcataccacagactggtcaagtccaggttcagggagttgcaattggtggttcatcttttcctggtcaaacccaagtagttgctaatgtgcctcttggtctgccaggaaatattacgtttgtaccaatcaatagtgtcgatctagattctttgggactctcgggcagttctcagacaatgactgcaggcattaatgccgacggacatttgataaacacaggacaagctatggatagttcagacaattcagaaaggactggtgagcgggtttctcctgatattaatgaaactaatactgatacagatttatttgtgccaacatcctcttcatcacagttgcctgttacgatagatagtacaggtatattacaacaaaacacaaatagcttgactacatctagtgggcaggttcattcttcagatcttcagggaaattatatccagtcgcctgtttctgaagagacacaggcacagaatattcaggtttctacagcacagcctgttgtacagcatctacaacttcaagagtctcagcagccaaccagtcaagcccaaattgtgcaaggtattacaccacagacaatccatggtgtgcaagccagtggtcaaaatatatcacaacaggctttgcaaaatcttcagttgcagctgaatcctggaacctttttaattcaggcacagacagtgaccccttctggacaggtaacttggcaaacgtttcaagtacaaggggtccagaacttgcagaatttgcaaatacagaatactgctgcccaacaaataactttgacgcctgttcaaaccctcacacttggtcaagttgcggcaggtggagccttcacttcaactccagttagtctaagcactggtcagttgccaaatctacaaacagttacagtgaactctatagattctgctggtatacagctacatccaggagagaatgctgacagtcctgcagatattaggatcaaggaagaagaacctgatcctgaagagtggcagctcagtggtgattctaccttgaataccaatgacctaacacacttaagagtacaggtggtagatgaagaaggggaccaacaacatcaagaaggaaaaagacttcggagggtagcttgcacctgtcccaactgtaaagaaggtggtggaagaggtaccaatcttgggaaaaagaagcaacacatttgtcatataccaggatgtggtaaagtctatgggaagacctcacatctgagagctcatctgcgttggcattctggagaacgcccttttgtttgtaactggatgtactgtggtaaaagatttactcgaagtgatgaattacagaggcacagaagaacacatacaggtgagaagaaatttgtttgtccagaatgttcaaaacgctttatgagaagtgaccaccttgccaaacatattaaaacacaccagaataaaaaaggtattcactctagcagtacagtgctggcatctgtggaagctgcgcgagatgatactttgattactgcaggaggaacaacgcttatccttgcaaatattcaacaaggttctgtttcagggataggaactgttaatacttccgccaccagcaatcaagatatccttaccaacactgaaatacctttacagcttgtcacagtttctggaaatgagacaatggagtaaatattacacaaatacttattcattgtggttatttttatacagtagtgagaagaatattgttcctaagttcttagatatctttttattgatgtgcaaaaatttttggattgacagtaacttggttatacatgacactgaaatgccttactttgtatgatattccatagtatattaaaaatggtaaaattgcatgggttttgtaggtacttttggaatctagaagaaatgaaattttaccaagttatataaagagaaaattgaatttaacaatgcgaatggtagtctaaccaaatgcatcaatcctgtgtggtttagtgtaaaaatgagaacatgttggtatttatctattgtaagataaaaaagctggtgggtgaaagaaatcatgttatgataaaaaattttgtaattttcttgatgactggaatttttattatgcataactgacaaatcaagtttccaagcaaatgttacatagtgtaggctttacttagcttatcaatttgtcattttgaagctaattattttaattaggttaactatgtacaatattttaagcattactcttgtaagattttgaaaactacattttaacatggaactctagggatagtcaccttttaaatcctgttgaaaagccatgtttaagatttaatttgccaaaataatgtcttgttaatattctttcaataacgaagttgggcaatataaccaatgtttaaaaaagtttaaaatgtataagttgaggcatttgggtggtaagagaatgttatagtgaattatcccttttcttgactattggaggaccaaaaaaataaggtgtattgcgtcttagcagtgatttttatccaatcttgtttccaaaaaccatgtctcccagggccttaaaagccatcatgtaaattaccagtaaagtgtaacatatgcaaacataacaaaatcacttccatagtgacgatactccaaccatatggatattagtcatagaagaactagaggttttatgatatttttttaagtcttttttttttttgtctaggtagtcagtctgcacttaaatatcaatcattttccttttttgcttcttcccttaaaatttatatgtatccagtacatttaattgagaagcgtatgttttttattatgctgtattttctttttattttttaattattgtttatattttcaattcaaaaatgtacaaaataaagttacattgctggtcttgtaagagctatacagttttcctaaatgtatacctgtaactgcagcagttcacctatttcaaaaatttggaattctgttcatttgttattcttaagaccacctcaaatttaaaggctaccttattgtacgtttaaagtgtattataacagtgtggtagttaataaaacactatttttttttcttttgagtttgttgtattcctatgcataaaaaatattgcagtggtatggggtaagaattggtggtttatttttcttcaacttggctttttatttttagattcttgattttagacactgaattgtaaacaggcatttatttgaagaagagatatatagagacactggtcatttactaattttttacctagagtaaataagaatgagcttattaaataaaatttttgaaaaaaagtcttagcccttagcccacattgattcatatcagttttatcagtaccattttgcaatttttttgttttccgttttaaagcaatgcagaatattttgatttatcgaaaacctgaatttacattaagactcctgaaaatgataagacaagcgttggtaaccatggcaggagttacttgaaaaagttgcctttgaatttgcatgtgtttcatcattataaaggcagagtaggaggaaagagtattaatgtgattgtgtattgtagatgttttaaagtaaaaatcaagtttcttaacacatgtatacagtgggggtaaagatgtccattttctgttttccaggcccagtctgactctgtctgtaatacctgattgcattggagaactctagacacgcataaacatggacagtttttctaaatgtgagacttaagcctgtgatgtaaaataggaagttctacttggaataatataaaggaaccactagaatttacaattattttgaagttacagggattagattttgaatcttaaaatcctttaggtaatttttagaatttttaaattaagattaatgtgaagagaattaagtgagcagcaggtggttcacttgagcaaactgcccattaagtcagattaaaccatttgaatgatagtagagatgttttaagtaatactggatttttacagtaagtttatggtgtactttgaatcgataggtgtccatgcatattttatgaattcgtggagaatgaatgcaatgaagaaagtaagtagtcttgaaaattatttaaataaagttgtagatttttttagtgccccctaggaatatattagtgaactttggaacttttaccaaagttatgtaacctcagtgtagataattttaaatatttctatttttatattttaaaatgttgaatatactctggaaacaacatttgaagatttgctctgatgtcaactttttctggttataaaacctattagtattgtgtataattctcagggtaggtatactctaataggtgttttgtcaattgctttatttttgtaaaggctagagttagtgcatattgaatatatttatgtacaaataattcctgttgtaacatttagtggacgcgattatctgtatacctcaaattttaatttaagaaagtatcacttaaagagcatctcattttctatagattgaggcttaattactgaaaagtgactcaaccaaaaagcacataaccttttaaaggagctacacctaccgcagaaagtcagatgccctgtaaataactttggtctttcaaaatagtggcaatgcttaagatacttaaaaatacacatacatataagctgaaagcatgtcaagcctatttcatagaaaatagttcttaaacagtattgttcattagaaattgctggggagcattttagagattccataggcctggtagccacctcagcttactaaatcaacatctctggagatggagtgtatatgtgttttgaaacagctgctcaagtggttctgttaaacactcctgcgttacaatcacttaaaatagagcaagcatccccttaggctcttaattgtagtttaaattccagtactgcctactcagacccaaaagttttgttttatgaaaaatttgtattgtgttcaatattgtttgaaatttggggttgttgcataaatgattatggaataacatttggttttaaaataatataaactgacatgttatgctacctgttacacaatttggttttcagttttaattatatgaagctggtaacaatcgtttttgttgtaaaagaattatttttcactaaacagtatgtttaaaactga

SEQ ID NO: 211 - DNA, 6008 bp, Homo sapiens
cctcgcccgcctgccgcctttttgtgcgcgtgtgagtgtgggccccagcgtgccctcccgggggtgggttccgggcggaaggcggaggcccggcgcgcagcccgccgcccgcctgcccgcggaccggggagccggggtgcttggagcgggggacgccaggcgtgggctggcggcgggaccaggaggaggaggaggaggaggaggagagcgcgggctggcgcttgcccgggcgcagtcggcggggaccgagtcgtacttcctgtgcgaaaggcggcccgaccctaaccgccaccccctccccctgtctccctctctgaacccgcccattgggggtaggacactcagccgtcaccgctcgctctgctggccgctacctgcagcaagatagggccgccatcgccgggcgacgacgaggaggaggcggccgccgcagccggggcccccgccgccgccggagcgacaggtgatttggcttctgcacagttaggaggagcaccaaaccgatgggaggttttgtcagccacacctacaactataaaagatgaagctggtaatctagtccagattccaagtgctgctacttcaagtgggcagtatgttcttccccttcagaatttgcagaatcaacaaatattttccgttgcaccaggatcagattcatcaaatggtacagtgtccagtgttcaatatcaagtgataccacagatccagtcagcagatggtcagcaggttcaaattggtttcacaggctcttcagataatgggggtataaatcaagaaagcagtcaaattcagatcattcctggctctaatcaaaccttacttgcctctggaacaccttctgctaacatccagaatctcataccacagactggtcaagtccaggttcagggagttgcaattggtggttcatcttttcctggtcaaacccaagtagttgctaatgtgcctcttggtctgccaggaaatattacgtttgtaccaatcaatagtgtcgatctagattctttgggactctcgggcagttctcagacaatgactgcaggcattaatgccgacggacatttgataaacacaggacaagctatggatagttcagacaattcagaaaggactggtgagcgggtttctcctgatattaatgaaactaatactgatacagatttatttgtgccaacatcctcttcatcacagttgcctgttacgatagatagtacaggtatattacaacaaaacacaaatagcttgactacatctagtgggcaggttcattcttcagatcttcagggaaattatatccagtcgcctgtttctgaagagacacaggcacagaatattcaggtttctacagcacagcctgttgtacagcatctacaacttcaagagtctcagcagccaaccagtcaagcccaaattgtgcaaggtattacaccacagacaatccatggtgtgcaagccagtggtcaaaatatatcacaacaggctttgcaaaatcttcagttgcagctgaatcctggaacctttttaattcaggcacagacagtgaccccttctggacaggtaacttggcaaacgtttcaagtacaaggggtccagaacttgcagaatttgcaaatacagaatactgctgcccaacaaataactttgacgcctgttcaaaccctcacacttggtcaagttgcggcaggtggagccttcacttcaactccagttagtctaagcactggtcagttgccaaatctacaaacagttacagtgaactctatagattctgctggtatacagctacatccaggagagaatgctgacagtcctgcagatattaggatcaaggaagaagaacctgatcctgaagagtggcagctcagtggtgattctaccttgaataccaatgacctaacacacttaagagtacaggtggtagatgaagaaggggaccaacaacatcaagaaggaaaaagacttcggagggtagcttgcacctgtcccaactgtaaagaaggtggtggaagaggtaccaatcttgggaaaaagaagcaacacatttgtcatataccaggatgtggtaaagtctatgggaagacctcacatctgagagctcatctgcgttggcattctggagaacgcccttttgtttgtaactggatgtactgtggtaaaagatttactcgaagtgatgaattacagaggcacagaagaacacatacaggtgagaagaaatttgtttgtccagaatgttcaaaacgctttatgagaagtgaccaccttgccaaacatattaaaacacaccagaataaaaaaggtattcactctagcagtacagtgctggcatctgtggaagctgcgcgagatgatactttgattactgcaggaggaacaacgcttatccttgcaaatattcaacaaggttctgtttcagggataggaactgttaatacttccgccaccagcaatcaagatatccttaccaacactgaaatacctttacagcttgtcacagtttctggaaatgagacaatggagtaaatattacacaaatacttattcattgtggttatttttatacagtagtgagaagaatattgttcctaagttcttagatatctttttattgatgtgcaaaaatttttggattgacagtaacttggttatacatgacactgaaatgccttactttgtatgatattccatagtatattaaaaatggtaaaattgcatgggttttgtaggtacttttggaatctagaagaaatgaaattttaccaagttatataaagagaaaattgaatttaacaatgcgaatggtagtctaaccaaatgcatcaatcctgtgtggtttagtgtaaaaatgagaacatgttggtatttatctattgtaagataaaaaagctggtgggtgaaagaaatcatgttatgataaaaaattttgtaattttcttgatgactggaatttttattatgcataactgacaaatcaagtttccaagcaaatgttacatagtgtaggctttacttagcttatcaatttgtcattttgaagctaattattttaattaggttaactatgtacaatattttaagcattactcttgtaagattttgaaaactacattttaacatggaactctagggatagtcaccttttaaatcctgttgaaaagccatgtttaagatttaatttgccaaaataatgtcttgttaatattctttcaataacgaagttgggcaatataaccaatgtttaaaaaagtttaaaatgtataagttgaggcatttgggtggtaagagaatgttatagtgaattatcccttttcttgactattggaggaccaaaaaaataaggtgtattgcgtcttagcagtgatttttatccaatcttgtttccaaaaaccatgtctcccagggccttaaaagccatcatgtaaattaccagtaaagtgtaacatatgcaaacataacaaaatcacttccatagtgacgatactccaaccatatggatattagtcatagaagaactagaggttttatgatatttttttaagtcttttttttttttgtctaggtagtcagtctgcacttaaatatcaatcattttccttttttgcttcttcccttaaaatttatatgtatccagtacatttaattgagaagcgtatgttttttattatgctgtattttctttttattttttaattattgtttatattttcaattcaaaaatgtacaaaataaagttacattgctggtcttgtaagagctatacagttttcctaaatgtatacctgtaactgcagcagttcacctatttcaaaaatttggaattctgttcatttgttattcttaagaccacctcaaatttaaaggctaccttattgtacgtttaaagtgtattataacagtgtggtagttaataaaacactatttttttttcttttgagtttgttgtattcctatgcataaaaaatattgcagtggtatggggtaagaattggtggtttatttttcttcaacttggctttttatttttagattcttgattttagacactgaattgtaaacaggcatttatttgaagaagagatatatagagacactggtcatttactaattttttacctagagtaaataagaatgagcttattaaataaaatttttgaaaaaaagtcttagcccttagcccacattgattcatatcagttttatcagtaccattttgcaatttttttgttttccgttttaaagcaatgcagaatattttgatttatcgaaaacctgaatttacattaagactcctgaaaatgataagacaagcgttggtaaccatggcaggagttacttgaaaaagttgcctttgaatttgcatgtgtttcatcattataaaggcagagtaggaggaaagagtattaatgtgattgtgtattgtagatgttttaaagtaaaaatcaagtttcttaacacatgtatacagtgggggtaaagatgtccattttctgttttccaggcccagtctgactctgtctgtaatacctgattgcattggagaactctagacacgcataaacatggacagtttttctaaatgtgagacttaagcctgtgatgtaaaataggaagttctacttggaataatataaaggaaccactagaatttacaattattttgaagttacagggattagattttgaatcttaaaatcctttaggtaatttttagaatttttaaattaagattaatgtgaagagaattaagtgagcagcaggtggttcacttgagcaaactgcccattaagtcagattaaaccatttgaatgatagtagagatgttttaagtaatactggatttttacagtaagtttatggtgtactttgaatcgataggtgtccatgcatattttatgaattcgtggagaatgaatgcaatgaagaaagtaagtagtcttgaaaattatttaaataaagttgtagatttttttagtgccccctaggaatatattagtgaactttggaacttttaccaaagttatgtaacctcagtgtagataattttaaatatttctatttttatattttaaaatgttgaatatactctggaaacaacatttgaagatttgctctgatgtcaactttttctggttataaaacctattagtattgtgtataattctcagggtaggtatactctaataggtgttttgtcaattgctttatttttgtaaaggctagagttagtgcatattgaatatatttatgtacaaataattcctgttgtaacatttagtggacgcgattatctgtatacctcaaattttaatttaagaaagtatcacttaaagagcatctcattttctatagattgaggcttaattactgaaaagtgactcaaccaaaaagcacataaccttttaaaggagctacacctaccgcagaaagtcagatgccctgtaaataactttggtctttcaaaatagtggcaatgcttaagatacttaaaaatacacatacatataagctgaaagcatgtcaagcctatttcatagaaaatagttcttaaacagtattgttcattagaaattgctggggagcattttagagattccataggcctggtagccacctcagcttactaaatcaacatctctggagatggagtgtatatgtgttttgaaacagctgctcaagtggttctgttaaacactcctgcgttacaatcacttaaaatagagcaagcatccccttaggctcttaattgtagtttaaattccagtactgcctactcagacccaaaagttttgttttatgaaaaatttgtattgtgttcaatattgtttgaaatttggggttgttgcataaatgattatggaataacatttggttttaaaataatataaactgacatgttatgctacctgttacacaatttggttttcagttttaattatatgaagctggtaacaatcgtttttgttgtaaaagaattatttttcactaaacagtatgtttaaaactga

SEQ ID NO: 212 - DNA, 4394 bp, Homo sapiens
agcccacgtgagagggcaggacgcctgagagcttgaggccacacgaggctgtggagcggcgtgactcaaacgtggcgcgcatcagctcgcacacttccaaacctcgcgatagctactggccctgggcgagccgttgggattgcgcttgcgcacagcgtgtcttgtacgttcccgcgcttttctggaatctttcgcccccggaagggcagcggcgggcgcctgtgtggaaggtggggtggccagagacacccgagggacctgagctggatcgccatacctaccctgtggtcctcatcttcctggcctcatagctcctcctctccaagcatgtcttccccgttgcaaagagctgtgggagataccaagagggccttgtctgcatcttctagttcctctgccagtctaccctttgatgacagggactcaaaccatacctcagaggggaatggcgactctttgttagctgatgaagacactgactttgaagacagcttgaatcgcaatgtgaagaagagagcagcaaaacgaccaccgaaaacaacaccggtggcaaaacatccaaagaaagggtcccgagtggtacatcgtcatagccggaaacagtcagagccaccagccaatgatcttttcaatgctgtgaaagccgccaaaagtgacatgcagtctttggtagatgagtggctggatagctacaagcaagaccaggatgcaggatttctggagcttgttaactttttcatccaatcttgcggatgtaaaggcattgtgacccctgagatgttcaagaagatgtccaactcagagatcatccagcacctaacagagcagtttaatgaggactcgggggactaccctctcatagctccaggtccatcctggaagaagttccagggcagcttctgtgaatttgtgaggacattggtctgtcagtgccagtacagcctcctctatgatggcttccctatggacgacctcatctccctgctcactggcctctcagactcacaagtccgcgccttccgtcacactagcaccctggctgctatgaaactgatgacctccctggtaaaagttgccctccaactgagtgtgcaccaagataacaatcagcgtcagtatgaggctgaaagaaacaaggggccagggcagagggcacctgagcggctggagagcctgttggagaaacgcaaagagctccaagagcatcaagaggagattgaggggatgatgaatgccctcttcaggggtgtctttgttcatcggtacagggatgtccttcctgagatccgtgctatctgcattgaggaaattgggtgttggatgcaaagctacagcacgtctttcctcaccgacagctatttaaaatatattggttggactctgcatgataagcaccgagaagtccgcctgaagtgtgtgaaggccctgaaagggctgtacggtaaccgggacctgaccacacgcctggagctcttcaccagccgcttcaaggaccggatggtttccatggtcatggacagagagtatgatgtggcagtggaggctgtcagattactgatacttatccttaagaacatggaaggggtgctgacggacgcggattgtgagagcgtctacccagttgtgtatgcctctcatcgaggcctggcctctgccgcaggcgaatttctgtactggaaactcttctaccctgagtgcgagataagaatgatgggtggaagagagcaacgccagagcccaggcgcccagaggactttcttccagcttctgctgtccttctttgtggagagcgagctccatgaccacgctgcttacttagtagacagtctgtgggactgtgcaggggctcggctgaaggactgggagggtctgacaagcctgctgctggagaaggaccagaacctgggtgatgtgcaggagagcacactgatagaaatccttgtgtccagtgcccggcaagcttcagaggggcacccgcctgtgggccgggtcactgggaggaagggcttaacctctaaggagcgcaagacccaagccgatgacagggtgaagttgactgagcacctcatccccctgctgccccagctcctggccaagttctcagctgatgcagagaaggtcactcccctgctccagcttctcagctgctttgacctccacatctactgcactgggcgcttggagaagcacctggagctgttcctgcagcaactccaggaggtggtggtgaagcatgcagagccagcggtgcttgaggctggggcgcatgccctctacctgctctgtaatcccgaattcactttcttcagccgggcggactttgcccgcagccagctagtagatttgctgactgaccgcttccagcaggagcttgaagagctgttacagtcgtccttcctagatgaggatgaggtatataatctggcagccactctgaaacgcctctctgccttctacaacactcatgacctgactcgctgggagctctatgagccatgttgccaactcctgcagaaggctgtggacacaggagaggttcctcaccaggttatcctgccagccttgactcttgtctatttttccattctctggacactaacccacatttctaaatcagatgcttcccagaagcagctgtcgagtttgagggacagaatggtggccttctgtgaactctgccagagttgcctctcagatgtggatactgagatccaggagcaggcttttgtcttattaagtgatctacttctcatctttagccctcagatgattgttgggggccgtgatttccttaggccacttgtcttttttcctgaagctactctccagtctgagctagccagcttcctcatggaccacgtcttcatccagccgggagacctgggcagtggtgattcccaggaggatcatttacagatagagcggctacaccagcggcgccgcctcctagccgggttctgcaagctgttgctttatggggtgctggagatggatgcagcctcagatgttttcaaacactacaacaagttctacaatgactatggtgacattatcaaggaaacattaactagagcaaggcagattgaccgaagtcattgttcccgaatcctgctgctgagcctcaagcagctgtacacagaactgctgcaggagcatgggccccagggcctgaatgagcttcctgccttcatcgagatgagggacctggcccggaggtttgccttgagttttggaccccagcagctgcagaaccgtgacctcgtggtcatgctacacaaggaaggcatccagttctccttgtctgagcttcctccagctggctcctccaatcagcctccaaatctggcattcctggagctcctttcagagttttccccccgactcttccatcaggacaagcagcttttactgtcctatctagaaaagtgcctgcagcatgtctcccaggcacctggccatccctggggcccagtcaccacctactgccactccctcagccctgtggagaacacagcagagaccagccctcaggtcctccccagctccaagaggaggcgcgttgaagggcctgccaagcctaacagagaggacgtctcctcgtcccaggaagaaagtctgcagctgaacagcatcccgcccacgcccaccctcacctccacagctgtgaagagcaggcagcccctgtgggggttgaaagagatggaggaagaagatggctcagagttggattttgcccagggtcagcccgtcgcaggcaccgagaggtcaaggttcttgggtccacaatatttccagactccacacaacccttcaggtcctggcctgggcaaccagctgatgcgactcagccttatggaagaggacgaggaagaagagttagaaatccaggatgagtcaaatgaagaacggcaggatacagacatgcaagcaagtagctactcttccaccagtgagcgcgggctggacctcttagattctacagagctggatattgaggatttctgacaggactctgggcccctccccagctccactccctacctcaagaatgtgaccatttggaaaaggcaaagagaaaaggagcaaaatgaagcattcccccaggcttcagccctgggctctgaggggaaagagttgggcattgtttttctaacctaacctttccctctggggtagagaagccgagagaccctgtcctccctaatgcactgtggcccagtccccttgcctttttcctgttctgtttggagtggagaagggcagcacctctgtgtttaatggaaatagcccatagtctcctggatttttggaacatctttctcagcctattttgtgtcctaatgattcgctcaataaacatgtttgaatccacacgttaaaaaaaaaaaaaaaaa

SEQ ID NO: 213 - DNA, 4313 bp, Homo sapiens
cgggccgcccgcgtgcccaagcccacgtgagagggcaggacgcctgagagcttgaggccacacgaggctgtggagcggcgtgactcaaacgtggcgcgcatcagctcgcacacttccaaacctcgcgatagctactggccctgggcgagccgttgggattgcgcttgcgcacagcgtgtcttctggatcgccatacctaccctgtggtcctcatcttcctggcctcatagctcctcctctccaagcatgtcttccccgttgcaaagagctgtgggagataccaagagggccttgtctgcatcttctagttcctctgccagtctaccctttgatgacagggactcaaaccatacctcagaggggaatggcgactctttgttagctgatgaagacactgactttgaagacagcttgaatcgcaatgtgaagaagagagcagcaaaacgaccaccgaaaacaacaccggtggcaaaacatccaaagaaagggtcccgagtggtacatcgtcatagccggaaacagtcagagccaccagccaatgatcttttcaatgctgtgaaagccgccaaaagtgacatgcagtctttggtagatgagtggctggatagctacaagcaagaccaggatgcaggatttctggagcttgttaactttttcatccaatcttgcggatgtaaaggcattgtgacccctgagatgttcaagaagatgtccaactcagagatcatccagcacctaacagagcagtttaatgaggactcgggggactaccctctcatagctccaggtccatcctggaagaagttccagggcagcttctgtgaatttgtgaggacattggtctgtcagtgccagtacagcctcctctatgatggcttccctatggacgacctcatctccctgctcactggcctctcagactcacaagtccgcgccttccgtcacactagcaccctggctgctatgaaactgatgacctccctggtaaaagttgccctccaactgagtgtgcaccaagataacaatcagcgtcagtatgaggctgaaagaaacaaggggccagggcagagggcacctgagcggctggagagcctgttggagaaacgcaaagagctccaagagcatcaagaggagattgaggggatgatgaatgccctcttcaggggtgtctttgttcatcggtacagggatgtccttcctgagatccgtgctatctgcattgaggaaattgggtgttggatgcaaagctacagcacgtctttcctcaccgacagctatttaaaatatattggttggactctgcatgataagcaccgagaagtccgcctgaagtgtgtgaaggccctgaaagggctgtacggtaaccgggacctgaccacacgcctggagctcttcaccagccgcttcaaggaccggatggtttccatggtcatggacagagagtatgatgtggcagtggaggctgtcagattactgatacttatccttaagaacatggaaggggtgctgacggacgcggattgtgagagcgtctacccagttgtgtatgcctctcatcgaggcctggcctctgccgcaggcgaatttctgtactggaaactcttctaccctgagtgcgagataagaatgatgggtggaagagagcaacgccagagcccaggcgcccagaggactttcttccagcttctgctgtccttctttgtggagagcgagctccatgaccacgctgcttacttagtagacagtctgtgggactgtgcaggggctcggctgaaggactgggagggtctgacaagcctgctgctggagaaggaccagaacctgggtgatgtgcaggagagcacactgatagaaatccttgtgtccagtgcccggcaagcttcagaggggcacccgcctgtgggccgggtcactgggaggaagggcttaacctctaaggagcgcaagacccaagccgatgacagggtgaagttgactgagcacctcatccccctgctgccccagctcctggccaagttctcagctgatgcagagaaggtcactcccctgctccagcttctcagctgctttgacctccacatctactgcactgggcgcttggagaagcacctggagctgttcctgcagcaactccaggaggtggtggtgaagcatgcagagccagcggtgcttgaggctggggcgcatgccctctacctgctctgtaatcccgaattcactttcttcagccgggcggactttgcccgcagccagctagtagatttgctgactgaccgcttccagcaggagcttgaagagctgttacagtcgtccttcctagatgaggatgaggtatataatctggcagccactctgaaacgcctctctgccttctacaacactcatgacctgactcgctgggagctctatgagccatgttgccaactcctgcagaaggctgtggacacaggagaggttcctcaccaggttatcctgccagccttgactcttgtctatttttccattctctggacactaacccacatttctaaatcagatgcttcccagaagcagctgtcgagtttgagggacagaatggtggccttctgtgaactctgccagagttgcctctcagatgtggatactgagatccaggagcaggcttttgtcttattaagtgatctacttctcatctttagccctcagatgattgttgggggccgtgatttccttaggccacttgtcttttttcctgaagctactctccagtctgagctagccagcttcctcatggaccacgtcttcatccagccgggagacctgggcagtggtgattcccaggaggatcatttacagatagagcggctacaccagcggcgccgcctcctagccgggttctgcaagctgttgctttatggggtgctggagatggatgcagcctcagatgttttcaaacactacaacaagttctacaatgactatggtgacattatcaaggaaacattaactagagcaaggcagattgaccgaagtcattgttcccgaatcctgctgctgagcctcaagcagctgtacacagaactgctgcaggagcatgggccccagggcctgaatgagcttcctgccttcatcgagatgagggacctggcccggaggtttgccttgagttttggaccccagcagctgcagaaccgtgacctcgtggtcatgctacacaaggaaggcatccagttctccttgtctgagcttcctccagctggctcctccaatcagcctccaaatctggcattcctggagctcctttcagagttttccccccgactcttccatcaggacaagcagcttttactgtcctatctagaaaagtgcctgcagcatgtctcccaggcacctggccatccctggggcccagtcaccacctactgccactccctcagccctgtggagaacacagcagagaccagccctcaggtcctccccagctccaagaggaggcgcgttgaagggcctgccaagcctaacagagaggacgtctcctcgtcccaggaagaaagtctgcagctgaacagcatcccgcccacgcccaccctcacctccacagctgtgaagagcaggcagcccctgtgggggttgaaagagatggaggaagaagatggctcagagttggattttgcccagggtcagcccgtcgcaggcaccgagaggtcaaggttcttgggtccacaatatttccagactccacacaacccttcaggtcctggcctgggcaaccagctgatgcgactcagccttatggaagaggacgaggaagaagagttagaaatccaggatgagtcaaatgaagaacggcaggatacagacatgcaagcaagtagctactcttccaccagtgagcgcgggctggacctcttagattctacagagctggatattgaggatttctgacaggactctgggcccctccccagctccactccctacctcaagaatgtgaccatttggaaaaggcaaagagaaaaggagcaaaatgaagcattcccccaggcttcagccctgggctctgaggggaaagagttgggcattgtttttctaacctaacctttccctctggggtagagaagccgagagaccctgtcctccctaatgcactgtggcccagtccccttgcctttttcctgttctgtttggagtggagaagggcagcacctctgtgtttaatggaaatagcccatagtctcctggatttttggaacatctttctcagcctattttgtgtcctaatgattcgctcaataaacatgtttgaatccacacgttaaaaaaaaaaaaaaaaa

SEQ ID NO: 214 - DNA, 4397 bp, Homo sapiens
agcccacgtgagagggcaggacgcctgagagcttgaggccacacgaggctgtggagcggcgtgactcaaacgtggcgcgcatcagctcgcacacttccaaacctcgcgatagctactggccctgggcgagccgttgggattgcgcttgcgcacagcgtgtcttgtacgttcccgcgcttttctggaatctttcgcccccggaagggcagcggcgggcgcctgtgtggaaggtggggtggccagagacacccgagggacctgagctggatcgccatacctaccctgtggtcctcatcttcctggcctcatagctcctcctctccaagcatgtcttccccgttgcaaagagctgtgggagataccaagagggccttgtctgcatcttctagttcctctgccagtctaccctttgatgacagggactcaaaccatacctcagaggggaatggcgactctttgttagctgatgaagacactgactttgaagacagcttgaatcgcaatgtgaagaagagagcagcaaaacgaccaccgaaaacaacaccggtggcaaaacatccaaagaaagggtcccgagtggtacatcgtcatagccggaaacagtcagagccaccagccaatgatcttttcaatgctgtgaaagccgccaaaagtgacatgcagtctttggtagatgagtggctggatagctacaagcaagaccaggatgcaggatttctggagcttgttaactttttcatccaatcttgcggatgtaaaggcattgtgacccctgagatgttcaagaagatgtccaactcagagatcatccagcacctaacagagcagtttaatgaggactcgggggactaccctctcatagctccaggtccatcctggaagaagttccagggcagcttctgtgaatttgtgaggacattggtctgtcagtgccagtacagcctcctctatgatggcttccctatggacgacctcatctccctgctcactggcctctcagactcacaagtccgcgccttccgtcacactagcaccctggctgctatgaaactgatgacctccctggtaaaagttgccctccaactgagtgtgcaccaagataacaatcagcgtcagtatgaggctgaaagaaacaaggggccagggcagagggcacctgagcggctggagagcctgttggagaaacgcaaagagctccaagagcatcaagaggagattgaggggatgatgaatgccctcttcaggggtgtctttgttcatcggtacagggatgtccttcctgagatccgtgctatctgcattgaggaaattgggtgttggatgcaaagctacagcacgtctttcctcaccgacagctatttaaaatatattggttggactctgcatgataagcaccgagaagtccgcctgaagtgtgtgaaggccctgaaagggctgtacggtaaccgggacctgaccacacgcctggagctcttcaccagccgcttcaaggaccggatggtttccatggtcatggacagagagtatgatgtggcagtggaggctgtcagattactgatacttatccttaagaacatggaaggggtgctgacggacgcggattgtgagagcgtctacccagttgtgtatgcctctcatcgaggcctggcctctgccgcaggcgaatttctgtactggaaactcttctaccctgagtgcgagataagaatgatgggtggaagagagcaacgccagagcccaggcgcccagaggactttcttccagcttctgctgtccttctttgtggagagcgagctccatgaccacgctgcttacttagtagacagtctgtgggactgtgcaggggctcggctgaaggactgggagggtctgacaagcctgctgctggagaaggaccagaacctgggtgatgtgcaggagagcacactgatagaaatccttgtgtccagtgcccggcaagcttcagaggggcacccgcctgtgggccgggtcactgggaggaagggcttaacctctaaggagcgcaagacccaagccgatgacagggtgaagttgactgagcacctcatccccctgctgccccagctcctggccaagttctcagctgatgcagagaaggtcactcccctgctccagcttctcagctgctttgacctccacatctactgcactgggcgcttggagaagcacctggagctgttcctgcagcaactccaggaggtggtggtgaagcatgcagagccagcggtgcttgaggctggggcgcatgccctctacctgctctgtaatcccgaattcactttcttcagccgggcggactttgcccgcagccagctagtagatttgctgactgaccgcttccagcaggagcttgaagagctgttacagtcgtccttcctagatgaggatgaggtatataatctggcagccactctgaaacgcctctctgccttctacaacactcatgacctgactcgctgggagctctatgagccatgttgccaactcctgcagaaggctgtggacacaggagaggttcctcaccaggttatcctgccagccttgactcttgtctatttttccattctctggacactaacccacatttctaaatcagatgcttcccagaagcagctgtcgagtttgagggacagaatggtggccttctgtgaactctgccagagttgcctctcagatgtggatactgagatccaggagcaggcttttgtcttattaagtgatctacttctcatctttagccctcagatgattgttgggggccgtgatttccttaggccacttgtcttttttcctgaagctactctccagtctgagctagccagcttcctcatggaccacgtcttcatccagccgggagacctgggcagtggtgattcccaggaggatcatttacagatagagcggctacaccagcggcgccgcctcctagccgggttctgcaagctgttgctttatggggtgctggagatggatgcagcctcagatgttttcaaacactacaacaagttctacaatgactatggtgacattatcaaggaaacattaactagagcaaggcagattgaccgaagtcattgttcccgaatcctgctgctgagcctcaagcagctgtacacagaactgctgcaggagcatgggccccagggcctgaatgagcttcctgccttcatcgagatgagggacctggcccggaggtttgccttgagttttggaccccagcagctgcagaaccgtgacctcgtggtcatgctacacaaggaaggcatccagttctccttgtctgagcttcctccagctggctcctccaatcagcctccaaatctggcattcctggagctcctttcagagttttccccccgactcttccatcaggacaagcagcttttactgtcctatctagaaaagtgcctgcagcatgtctcccaggcacctggccatccctggggcccagtcaccacctactgccactccctcagccctgtggagaacacagcagagaccagccctcaggtcctccccagctccaagaggaggcgcgttgaagggcctgccaagcctaacagagaggacgtctcctcgtcccaggaagaaagtctgcagctgaacagcatcccgcccacgcccaccctcacctccacagctgtgaagagcaggcagcccctgtgggggttgaaagagatggaggaagaagatggctcagagttggattttgcccagggcagtcagcccgtcgcaggcaccgagaggtcaaggttcttgggtccacaatatttccagactccacacaacccttcaggtcctggcctgggcaaccagctgatgcgactcagccttatggaagaggacgaggaagaagagttagaaatccaggatgagtcaaatgaagaacggcaggatacagacatgcaagcaagtagctactcttccaccagtgagcgcgggctggacctcttagattctacagagctggatattgaggatttctgacaggactctgggcccctccccagctccactccctacctcaagaatgtgaccatttggaaaaggcaaagagaaaaggagcaaaatgaagcattcccccaggcttcagccctgggctctgaggggaaagagttgggcattgtttttctaacctaacctttccctctggggtagagaagccgagagaccctgtcctccctaatgcactgtggcccagtccccttgcctttttcctgttctgtttggagtggagaagggcagcacctctgtgtttaatggaaatagcccatagtctcctggatttttggaacatctttctcagcctattttgtgtcctaatgattcgctcaataaacatgtttgaatccacacgttaaaaaaaaaaaaaaaaa

SEQ ID NO: 215 - DNA, 1164 bp, Homo sapiens
atggggaagattgatgtggacaagatcctctttttcaatcaagaaatcaggctgtggcagcttataatggcaacccctgaagaaaacagcaatccccatgacagagcaacaccccagctgccagcacagctgcaggagcttgagcatcgggtggcccggagacggctgtcccaggcccgccaccgagccaccctggcagcgctcttcaacaacctcaggaagacagtgtactctcagtctgatctcatagcctcaaagtggcaggttctgaataaggcaaagagtcatattccagaactggagcaaaccctggataatttgctgaagctgaaagcatccttcaacctggaagatgggcatgcaagcagcttagaggaggtcaagaaagaatatgccagcatgtattctggaaatgacagttttcctcagaatggttcctccccttggtatctcaacttttacaaacagacgatggaccttctgactggcagcgggatcattaccccgcaggaggcggcgctgcccatcgtctccgcggccatctcccacctgtggcagaacctctcggaggagaggaaggccagcctccggcaggcctgggcgcagaagcaccgcggccctgcgaccctggcggaggcctgccgagagccggcctgtgccgagggcagcgtgaaggacagcggcgtggacagccagggggccagctgctcgctggtctccacgcccgaggagatcctttttgaggatgcctttgatgtggcaagcttcctggacaaaagtgaggttccgagtacatctagctccagttcagtgcttgccagctgcaacccagaaaacccagaggagaagtttcagctctatatgcagatcatcaacttttttaaaggccttagctgtgcaaacactcaagtaaagcaggaagcatcctttcccgttgatgaagagatgatcatgttgcagtgcacagagacctttgacgatgaagatttgtaatgcagaagaggagctgcgaggggagggactgaatgaggtgggcagttcccaaggttgaatgctggcagctaaggttgcacctgccttggcctccaggactctttggagtgggttgttccagaagcattttgatgattttagtttctgattattataaagtataagagaagc

SEQ ID NO: 216 - DNA, 5541 bp, Homo sapiens
gcagagttgcgacgctcggcggcatagggggcggctccaccgacactacgcggacgcctcctgccgcagatacacaatcatcatcttactagttctctgtgttgctcgctaaccagtcccccagttcagtagactggagcccagagcctgcttacttgtcaggtgtttattttgtcttgctttttttttttttttaaatgaagtcaaaatgccaataagaccagatctccagcagttggaaaaatgcattgatgatgctttaagaaaaaatgatttcaaacctttgaaaacacttttgcaaattgatatttgtgaagatgtgaagattaaatgcagcaaacagtttttccacaaggtggacaaccttatatgcagggaacttaataaagaggatatccacaatgtttcagccattttggtttctgttggaagatgtggcaaaaatatcagtgtattggggcaagctggacttctaacgatgataaaacaaggactaatacaaaagatggttgcctggtttgaaaaatccaaggacattattcagagtcaaggaaattcaaaagatgaagctgttctaaatatgatagaagacttagttgatcttctgctggtcatacatgatgtcagtgatgaaggtaaaaaacaagtagtggaaagtttcgtacctcgcatttgttccctggttattgactcaagagtgaatatttgtattcagcaagagattataaaaaaaatgaatgctatgcttgacaaaatgcctcaagatgcccggaaaatactctctaaccaagaaatgttaattctcatgagtagtatgggagaaaggattttagatgctggagattatgacttacaggtaggcattgtagaagctttgtgtagaatgaccacagaaaaacaaagacaagaactggcacatcagtggttttcaatggattttattgctaaggcatttaaaagaattaaggactctgaatttgaaacagattgcaggatatttctcaaccttgtaaatggcatgcttggagacaaaagaagggtctttacatttccttgtttatcagcatttcttgataaatatgagctgcaaataccatcagatgaaaaacttgaggaattttggattgattttaatcttgggagtcagactctctcattctacattgctggagataatgatgatcatcaatgggaagcagttactgtgccagaggaaaaagtacaaatatacagcattgaagtgagagaatcaaagaagctactgacaataattctgaaaaatacagtaaaaattagcaaaagagaagggaaagaattgcttttgtattttgacgcatcactagaaatcactaatgtaactcaaaaaatttttggtgcaactaaacatagggaatctatcagaaaacaaggtatttcagttgccaaaacgtcgctgcatatactttttgacgcaagtggatcacagattctagtgccagaaagtcaaatctcaccagtcggagaagagctcgttagtttaaaggaaaaatcaaagtccccaaaggaatttgctaaaccttcaaaatatatcaaaaacagtgacaaagggaatagaaataatagtcagcttgagaaaactactcctagcaaaagaaaaatgtctgaagcatcaatgattgtttctggtgcagatagatacactatgagaagtccagtgcttttcagcaacacatcaataccaccacgaagaagaagaattaaaccaccactgcaaatgacgagctctgcagagaaacctagtgtttctcaaacatcagaaaatagagtggataatgctgcatcactgaaatctagatcatcagaaggaagacatagaagagataatatagacaaacatatcaaaactgctaagtgtgtagaaaacacagaaaataagaatgttgaattcccaaaccaaaattttagtgaactccaggatgttataccagattcacaggcagcggaaaaaagagatcatactatattacctggtgttttagacaacatctgtggaaataaaatacacagcaaatgggcatgttggacacctgtaacaaacattgaactatgtaataaccaaagagcaagtacttcgtcaggagacacattgaatcaagatattgttataaataaaaaacttactaaacaaaaatcatcctcttcaatatctgatcataattctgaaggaacaggaaaagtgaaatataagaaagaacaaaccgaccatatcaaaatagataaagcagaagtagaagtttgcaagaaacacaatcagcaacaaaatcatcctaaatattcagggcagaaaaatactgaaaatgccaagcagagtgattggcctgttgaatctgaaactacttttaaatcggttctcctaaataagacaattgaagaatcgctgatatataggaagaaatacatattgtcaaaagatgtgaatactgctacttgcgataaaaatccatctgctagcaaaaatgtgcaaagtcatagaaaagcagagaaagaattgacttctgagcttaattcctgggattcgaaacaaaaaaaaatgagagaaaagtcaaaagggaaagaatttaccaatgtagcagaatccttgataagccaaatcaataaaagatacaaaacaaaagatgacatcaagtctacaagaaaattaaaggagtctttgattaacagtggtttttcaaacaaacctgttgtacaactcagtaaggaaaaagttcagaaaaaaagctacagaaaactgaagactacctttgttaatgttacttctgaatgcccagtgaatgatgtttacaattttaatttgaatggagctgatgaccctatcataaaacttggaatccaagagtttcaagctacagctaaagaagcttgtgcggataggtcaattagattggtaggtccaaggaatcatgatgaacttaaatcttctgtcaaaacaaaagataaaaaaattataacaaatcatcaaaagaaaaatctgtttagtgatactgaaacagagtacagatgtgatgacagcaagactgatattagctggctaagagaaccgaaatcaaaaccacagctaatagactatagcagaaataaaaatgtgaagaatcataaaagtggaaaatcaagatcatccttggaaaagggacagccaagctctaaaatgacacccagtaaaaatatcacaaaaaagatggacaagacaattccggaaggaagaatcagacttccacgaaaagcaaccaaaacaaaaaaaaactataaagatctctcaaattcagaatcagagtgtgaacaagaattttcacattcatttaaagagaacataccagtaaaggaggagaatatccattccagaatgaaaacggtaaagctaccaaagaaacaacagaaagtcttctgtgctgaaacagaaaaggaactatcaaaacaatggaaaaactcatctctactaaaagatgctatacgagataattgccttgacttatctcccagatctttatctggcagtccatcatctatagaagtaacgagatgtatagagaaaataacagaaaaggattttactcaggattatgactgcataacaaaatctatatcaccttatccaaaaacttcatcacttgaatccttaaatagtaacagtggagttggaggtacaataaagtcacccaaaaacaatgagaaaaacttcctgtgtgcaagtgaaagttgttcaccaattccacgaccactgtttttgcccagacatactccaactaagagtaatactattgtaaatagaaaaaaaataagttctctggtacttacacaagaaacacaaaacagtaacagctattcagatgtaagcagttatagttcagaagaacggtttatggaaattgaatctccacatatcaatgaaaattatatacaaagcaaaagagaggaaagtcatttagcatcttcattatccaagtctagtgaaggaagagagaaaacgtggtttgacatgccctgtgatgctactcatgtatcaggccccacccaacatcttagtcgcaaaagaatatatatagaagataatctaagtaattccaatgaagtagaaatggaagagaaaggagaaaggagagcaaacttgcttcccaaaaaactgtgtaaaattgaagatgcagatcatcatatccacaaaatgtctgaaagtgtatcttcattatcaacaaatgacttttctattccttgggagacctggcaaaatgaatttgcagggatagagatgacttatgagacttacgagaggctcaattcagaatttaagagaaggaataatatccgacataaaatgttgagttattttactacgcagtcttggaaaacagctcagcaacatctgagaacaatgaatcatcaaagtcaggactctaggattaaaaaacttgataaattccaattcattatcatagaggagctggagaattttgaaaaagattcacagtctttaaaagatttggaaaaggaatttgtggacttttgggaaaagatatttcagaagttcagtgcatatcaaaaaagcgaacaacagaggcttcatcttttgaaaacttcattggctaaaagtgtcttctgtaatactgatagtgaagaaactgtttttacatccgagatgtgtttgatgaaagaagatatgaaagtgctgcaagacaggcttcttaaggacatgctagaagaggagcttcttaatgtacgcagagaactgatgtcagtattcatgtctcatgaaagaaatgctaatgtgtgaaatctagtttttatcaccatactttatctaattattattctctgtatataactgaggaaataagaatagtcctacaaagagaaaaatatacatgtcaccgaagcaagtgtaccctttataggaaccctcaaattaaaaaaaaatgtcttttaatggatgagagggaaccactataacatgagtccaagcccagaagacttctgtctatacaatatttttttttaattttggagataaaagctttaagaaactttttgagttaattatactcataaaatgagtttctttaataaattaaattttattgtgtaaaatgtattattacataaaatgtgtttttgaatcaatgcagtttggggatgaatataattaaaatatgtttaataacttagaattcaactaataaaaatttagccacacttacaagggggaggaagtccctagtttaaaatgtataactgagtggtagatcagtactttcagcacactgttggaaacatttattcagatatggctctaatgtattaggaagcactaaatggcctaaaaaagctactacattgcctaaatatgttaattcaatatagaagtcctatttcataaccaggctgtttgacaaatacttttaatctagtagtcattgtaatatcttgctagattaatttataaaaatgagtatacatttgatttgcttttaatgaagttgaaataaatgcttatgtcacttgaataaatataaa

SEQ ID NO: 217 - DNA, 1119 bp, Homo sapiens
agaagcgtcgcggagaaggggccacctcaggtgaagcgcgcttgtggaggagttgtggaggacgcctgtcgacgaccagtaactggtcctcggccattgcggtgtgtttcagtcaggaagcatctaaatatggtgtcctccggaaaaaagtattccaggaaatctgggaagccgtctgtggaagatcagtttacgagagcctatgactttgagactgaagataagaaagatctgagtggatcagaggaagatgttattgaagggaagactgcagtcattgagaaacgtaggaagaaaaggtcttctgcaggagtagttgaagatatggggggtgaagtgcagaatatgctggaaggagttggagttgacattaacaaggctcttcttgccaagagaaagagactagaaatgtataccaaggcttctctcaaaactagtaaccagaaaattgaacatgtttggaaaacacaacaagatcaaaggcagaagcttaaccaagaatattctcagcagtttctgactttgtttcagcagtgggatttagatatgcagaaagctgaggaacaagaagaaaaaatacttaatatgtttcgacagcaacaaaagattcttcaacaatctagaattgttcagagccagagattgaaaacaattaaacagttatatgagcagttcataaagagtatggaagagttggagaagaatcatgataatctacttactggtgcacaaaatgaatttaaaaaagaaatggctatgttgcaaaaaaaaattatgatggaaactcagcagcaagagatagcaagtgttcggaagtctcttcaatccatgttattctgatgactctttgaagaaagaacttgaacctaagtaatatgatacaattataacgttagctaagaagcatattgtaagtctttagaatagtttaattgtaacatctttaatcataaacctgtttcattgtaagacctccctttctgttaagtcaaatctaaatagttatgagttagttagcaactattcctaaagaatatgtattaagctttcagctctttagtaatgatagtgaatttttctctctaacactgtcaattaaataaagacgatttaatttta

SEQ ID NO: 218 - DNA, 1137 bp, Homo sapiens
agcttgcctcagaagcgtcgcggagaaggggccacctcaggtgaagcgcgcttgtggaggagttgtggaggacgcctgtcgacgaccagtaactggtcctcggccattgcggtgtgtttcaggaagcatctaaatatggtgtcctccggaaaaaagtattccaggaaatctgggaagccgtctgtggaagatcagtttacgagagcctatgactttgagactgaagataagaaagatctgagtggatcagaggaagatgttattgaagggaagactgcagtcattgagaaacgtaggaagaaaaggtcttctgcaggagtagttgaagatatggggggtgaagtgcagaatatgctggaaggagttggagttgacattaacaaggctcttcttgccaagagaaagagactagaaatgtataccaaggcttctctcaaaactagtaaccagaaaattgaacatgtttggaaaacacaacaagatcaaaggcagaagcttaaccaagaatattctcagcagtttctgactttgtttcagcagtgggatttagatatgcagaaagctgaggaacaagaagaaaaaatacttaatatgtttcgacagcaacaaaagattcttcaacaatctagaattgttcagagccagagattgaaaacaattaaacagttatatgagcagttcataaagagtatggaagagttggagaagaatcatgataatctacttactggtgcacaaaatgaatttaaaaaagaaatggctatgttgcaaaaaaaaattatgatggaaactcagcagcaagagatagcaagtgttcggaagtctcttcaatccatgttattctgatgactctttgaagaaagaacttgaacctaagtaatatgatacaattataacgttagctaagaagcatattgtaagtctttagaatagtttaattgtaacatctttaatcataaacctgtttcattgtaagacctccctttctgttaagtcaaatctaaatagttatgagttagttagcaactattcctaaagaatatgtattaagctttcagctctttagtaatgatagtgaatttttctctctaacactgtcaattaaataaagacgatttaattttaaaaaaaaaaaaa

SEQ ID NO: 219 - DNA, 1119 bp, Homo sapiens
agcttgcctcagaagcgtcgcggagaaggggccacctcaggtgaagcgcgcttgtggaggagttgtggaggacgcctgtcgacgaccagtaactggtcctcggccattgcggaagcatctaaatatggtgtcctccggaaaaaagtattccaggaaatctgggaagccgtctgtggaagatcagtttacgagagcctatgactttgagactgaagataagaaagatctgagtggatcagaggaagatgttattgaagggaagactgcagtcattgagaaacgtaggaagaaaaggtcttctgcaggagtagttgaagatatggggggtgaagtgcagaatatgctggaaggagttggagttgacattaacaaggctcttcttgccaagagaaagagactagaaatgtataccaaggcttctctcaaaactagtaaccagaaaattgaacatgtttggaaaacacaacaagatcaaaggcagaagcttaaccaagaatattctcagcagtttctgactttgtttcagcagtgggatttagatatgcagaaagctgaggaacaagaagaaaaaatacttaatatgtttcgacagcaacaaaagattcttcaacaatctagaattgttcagagccagagattgaaaacaattaaacagttatatgagcagttcataaagagtatggaagagttggagaagaatcatgataatctacttactggtgcacaaaatgaatttaaaaaagaaatggctatgttgcaaaaaaaaattatgatggaaactcagcagcaagagatagcaagtgttcggaagtctcttcaatccatgttattctgatgactctttgaagaaagaacttgaacctaagtaatatgatacaattataacgttagctaagaagcatattgtaagtctttagaatagtttaattgtaacatctttaatcataaacctgtttcattgtaagacctccctttctgttaagtcaaatctaaatagttatgagttagttagcaactattcctaaagaatatgtattaagctttcagctctttagtaatgatagtgaatttttctctctaacactgtcaattaaataaagacgatttaattttaaaaaa

SEQ ID NO: 220 - DNA, 4354 bp, Homo sapiens
acctctgctcccggaaccgcagcgccaaagctgccgctgagcccctgggggatgcccgccggcctcaccgaacccgccggcgccgctcccccggctgctgtgagcgcctcggggaccgtgaccatggccccggccggggcgctgccggtgcgggtggagagcactccggtggccctgggcgccgtgactaaggctcctgtcagcgtctgcgtggagcccacggcgtcccagcccctgcggtcccccgtggggaccctggtgaccaaagtggctccggtcagcgcccctcctaaagtcagcagcggccctaggctgcctgctcctcagatagtcgccgtgaaagcccccaacaccacgacaatccagtttcctgctaatttgcagcttcctccaggaaccgttttgattaaaagtaacagtggtccgttgatgttggtatctcctcagcaaactgtaacaagagccgagaccacaagtaacataacctcaaggccagcagtaccagcgaatcctcaaacagtcaaaatctgtacagtgccgaactctagctcacaattaatcaagaaagtggcagtgacacctgttaaaaaattggcacaaataggaactactgtggtaaccactgttccgaagccttcctcagtacaatctgtggctgtgccaaccagtgtcgtcacagttactcctggaaagccattgaatactgtaactaccctgaagccttcaagtttgggagcatcatccactccttcaaatgagcccaatcttaaagcagagaactcagcagctgttcagattaatctttctccgacaatgctagaaaatgtgaagaaatgcaagaacttccttgcaatgttaataaaactagcatgtagtggatcacagtccccagaaatggggcaaaatgtgaagaagctggtggaacaacttttggatgcaaaaatcgaagcagaagaatttactaggaaactgtatgttgaactcaagtcttcacctcagcctcacctggttccttttcttaagaaaagcgtggttgccttacgacaacttctgcctaactcccagagcttcatccagcaatgtgttcagcagacttctagtgacatggtcattgctacctgtactacaacagtaacaacttctcctgtggtgacaactacagtgtcctcaagccagtctgaaaagtcaattattgtttctggagcaacagcacccagaactgtgtcagtgcaaactttgaacccacttgctggtccagtgggagcaaaagctggagttgtgacacttcattctgtgggcccaactgctgcaacaggaggaacaacagctggaactggtttgcttcagacttcaaaaccacttgtgacatctgtggcaaacacagtgaccacggtctcactgcaacctgaaaagccagttgtctctggaacagcagtaacactgtcccttccagcagtaacttttggagaaacttcaggtgcagctatttgtcttccatctgtgaaacctgttgtttcttctgctgggaccacatctgacaagcctgttattgggactccagttcaaatcaaacttgcccagccgggccctgtcctttcacaaccagctgggattccacaggcagttcaagtcaagcaactattctcattgtttcaggtagttcagcagccttcaggaggcaatgaaaaacaagtgaccacaatttcacattcctcaacattgaccattcagaaatgtggacagaagacgatgccagtgaacaccataatacctactagtcagtttcctccagcttccattctaaagcaaattactctgcctggaaataaaattctgtcacttcaagcatctcctactcagaaaaatagaataaaagagaatgtaacatcatgcttccgagatgaggatgacatcaatgatgtgacttctatggcaggggtcaaccttaatgaagaaaatgcctgcatcttagcaacaaactctgaattggttggcacactcattcagtcatgtaaagatgaaccatttctttttattggagctctacaaaagagaattttagacattggtaaaaagcatgacattacagaacttaactctgatgctgtgaacttgatctcccaagcaacacaggaacgactacgaggccttctagaaaaactgactgcaattgctcagcatcgaatgactacttacaaggcaagtgaaaattacatcctgtgtagtgataccaggtcacagctcaaatttcttgaaaagctggatcaattggagaagcagagaaaggatttggaagaaagagaaatgttacttaaggcagccaagagtcgttctaataaagaagatccagaacagctgagattaaagcagaaagccaaagagttacagcaattggaacttgcacagatacagcatagagacgctaatctcacagctcttgcagctattggaccaaggaagaagagaccactagaatctggaattgagggcttaaaagacaaccttcttgcttctgggacatccagcctgacagccaccaaacagttgcatcgtccaagaatcacgagaatctgcctcagggacttgatattttgtatggaacaggaacgggagatgaagtattctcgagctctatacctggcccttctgaagtgaccactccactcttccatccagatccttgctatttactgccaaagaagacacaaagcattgttgcactgtcctgaaatttcaatttctggaaaataatcaccaacatgaaagagcattgtttacagttagaaactttattaactcttacctatccatctcatgggactcttacagactcagattcatctttgtcttctgaaaatcagttatgaaatacactttgcacagaattaggcatctgcctatctgtgcattaaattaaagcaagttaaggccctatttgttactacctgcctcatttgccaaattgtagcaggtgaggtgtccttccctaatacagcatgcattgagatgcaggagaaaggaagaggcataagaaaatacaagaatgactatttcattctatattgaacctgtcccaaagtggtaggttttctgggctggaatcagaagttgcttagctaactatgacagtcaccctctgtacgtgacaggccactgtggtgactttggtcggctgagttccagtgttgtcaaaacaagacaaatggggatagattgtgcctggggttgctaattctctgcttcatatcaccatatgccgtttctggtaccaagtgaggggacatgcttgtcagggaaaccttaaaattgaatctactgatatatcttgttgaaaaaatggaaaaggtgcaaagtattagaaggaacgttagggcgttgctttcaaactgatgaggggaatgtgaaaatggtatcataaaacaggaaatgtgcttcatatgcccaagaggggaagaggtggaatcggaactccaaaacaactggtacatgttttgttgatgggcaaaaaaaatcacagcacaaccagaaaggagaatgtaccagatgttttcaaattagagtatttcaaaaggaaaatgttattttttgttttgtattgttttaaatcccaaggatagtttttatagttccttctgtcataatatattttagttatcctaatttttaagcatgttggcacatttaaaaaatcctaattgatgatgagaaatttttaacaataggactttatgttggattctgtacttaaaaggtactgtcaatatctcactcttggggatatgagctctaaatatgagaagcaagttatatgtgttcacctgaggaagaagctgacggacaaagcaaaccctctttaaaaaaaaaaaaaagaaaattccacgtgtgtggaatacagccggtgaaaaataatcactgtagttagaatcacatacagaaaaaaaatgattgaatcctccaagaaggtatttcaaaaatgggaaatgctatacttataagaattgaaggaaaaaaaaaaaaacacctcacgtatgttattcttcatcctgttcttcccattgggactgttatggccatattctacagtatagtaaattttaaattggccacatttttttttgtttcagcaagttatgtaaaatgctataaattatgtgtatgttaaaggagtactttaagaagagatctttatccaaagttgtttttgtatatttaaatgcttacctttattttttgtaaagtgcagcatactcatttgtgtataatcttactgatcagatgtttaaaattattccaaatacttcattaaaataattattttattataagaaaaaaaaaaaaaaaaaaaaaaaaaaaa

SEQ ID NO: 221 - DNA, 4339 bp, Homo sapiens
acctctgctcccggaaccgcagcgccaaagctgccgctgagcccctgggggatgcccgccggcctcaccgaacccgccggcgccgctcccccggctgctgtgagcgcctcggggaccgtgaccatggccccggccggggcgctgccggtgcgggtggagagcactccggtggccctgggcgccgtgactaaggctcctgtcagcgtctgcgtggagcccacggcgtcccagcccctgcggtcccccgtggggaccctggtgaccaaagtggctccggtcagcgcccctcctaaagtcagcagcggccctaggctgcctgctcctcagatagtcgccgtgaaagcccccaacaccacgacaatccagtttcctgctaatttgcagcttcctccaggaaccgttttgattaaaagtaacagtggtccgttgatgttggtatctcctcagcaaactgtaacaagagccgagaccacaagtaacataacctcaaggccagcagtaccagcgaatcctcaaacagtcaaaatctgtacagtgccgaactctagctcacaattaatcaagaaagtggcagtgacacctgttaaaaaattggcacaaataggaactactgtggtaaccactgttccgaagccttcctcagtacaatctgtggctgtgccaaccagtgtcgtcacagttactcctggaaagccattgaatactgtaactaccctgaagccttcaagtttgggagcatcatccactccttcaaatgagcccaatcttaaagcagagaactcagcagctgttcagattaatctttctccgacaatgctagaaaatgtgaagaaatgcaagaacttccttgcaatgttaataaaactagcatgtagtggatcacagtccccagaaatggggcaaaatgtgaagaagctggtggaacaacttttggatgcaaaaatcgaagcagaagaatttactaggaaactgtatgttgaactcaagtcttcacctcagcctcacctggttccttttcttaagaaaagcgtggttgccttacgacaacttctgcctaactcccagagcttcatccagcaatgtgttcagcagacttctagtgacatggtcattgctacctgtactacaacagtaacaacttctcctgtggtgacaactacagtgtcctcaagccagtctgaaaagtcaattattgtttctggagcaacagcacccagaactgtgtcagtgcaaactttgaacccacttgctggtccagtgggagcaaaagctggagttgtgacacttcattctgtgggcccaactgctgcaacaggaggaacaacagctggaactggtttgcttcagacttcaaaaccacttgtgacatctgtggcaaacacagtgaccacggtctcactgcaacctgaaaagccagttgtctctggaacagcagtaacactgtcccttccagcagtaacttttggagaaacttcaggtgcagctatttgtcttccatctgtgaaacctgttgtttcttctgctgggaccacatctgacaagcctgttattgggactccagttcaaatcaaacttgcccagccgggccctgtcctttcacaaccagctgggattccacaggcagttcaagtcaagcaactagtagttcagcagccttcaggaggcaatgaaaaacaagtgaccacaatttcacattcctcaacattgaccattcagaaatgtggacagaagacgatgccagtgaacaccataatacctactagtcagtttcctccagcttccattctaaagcaaattactctgcctggaaataaaattctgtcacttcaagcatctcctactcagaaaaatagaataaaagagaatgtaacatcatgcttccgagatgaggatgacatcaatgatgtgacttctatggcaggggtcaaccttaatgaagaaaatgcctgcatcttagcaacaaactctgaattggttggcacactcattcagtcatgtaaagatgaaccatttctttttattggagctctacaaaagagaattttagacattggtaaaaagcatgacattacagaacttaactctgatgctgtgaacttgatctcccaagcaacacaggaacgactacgaggccttctagaaaaactgactgcaattgctcagcatcgaatgactacttacaaggcaagtgaaaattacatcctgtgtagtgataccaggtcacagctcaaatttcttgaaaagctggatcaattggagaagcagagaaaggatttggaagaaagagaaatgttacttaaggcagccaagagtcgttctaataaagaagatccagaacagctgagattaaagcagaaagccaaagagttacagcaattggaacttgcacagatacagcatagagacgctaatctcacagctcttgcagctattggaccaaggaagaagagaccactagaatctggaattgagggcttaaaagacaaccttcttgcttctgggacatccagcctgacagccaccaaacagttgcatcgtccaagaatcacgagaatctgcctcagggacttgatattttgtatggaacaggaacgggagatgaagtattctcgagctctatacctggcccttctgaagtgaccactccactcttccatccagatccttgctatttactgccaaagaagacacaaagcattgttgcactgtcctgaaatttcaatttctggaaaataatcaccaacatgaaagagcattgtttacagttagaaactttattaactcttacctatccatctcatgggactcttacagactcagattcatctttgtcttctgaaaatcagttatgaaatacactttgcacagaattaggcatctgcctatctgtgcattaaattaaagcaagttaaggccctatttgttactacctgcctcatttgccaaattgtagcaggtgaggtgtccttccctaatacagcatgcattgagatgcaggagaaaggaagaggcataagaaaatacaagaatgactatttcattctatattgaacctgtcccaaagtggtaggttttctgggctggaatcagaagttgcttagctaactatgacagtcaccctctgtacgtgacaggccactgtggtgactttggtcggctgagttccagtgttgtcaaaacaagacaaatggggatagattgtgcctggggttgctaattctctgcttcatatcaccatatgccgtttctggtaccaagtgaggggacatgcttgtcagggaaaccttaaaattgaatctactgatatatcttgttgaaaaaatggaaaaggtgcaaagtattagaaggaacgttagggcgttgctttcaaactgatgaggggaatgtgaaaatggtatcataaaacaggaaatgtgcttcatatgcccaagaggggaagaggtggaatcggaactccaaaacaactggtacatgttttgttgatgggcaaaaaaaatcacagcacaaccagaaaggagaatgtaccagatgttttcaaattagagtatttcaaaaggaaaatgttattttttgttttgtattgttttaaatcccaaggatagtttttatagttccttctgtcataatatattttagttatcctaatttttaagcatgttggcacatttaaaaaatcctaattgatgatgagaaatttttaacaataggactttatgttggattctgtacttaaaaggtactgtcaatatctcactcttggggatatgagctctaaatatgagaagcaagttatatgtgttcacctgaggaagaagctgacggacaaagcaaaccctctttaaaaaaaaaaaaaagaaaattccacgtgtgtggaatacagccggtgaaaaataatcactgtagttagaatcacatacagaaaaaaaatgattgaatcctccaagaaggtatttcaaaaatgggaaatgctatacttataagaattgaaggaaaaaaaaaaaaacacctcacgtatgttattcttcatcctgttcttcccattgggactgttatggccatattctacagtatagtaaattttaaattggccacatttttttttgtttcagcaagttatgtaaaatgctataaattatgtgtatgttaaaggagtactttaagaagagatctttatccaaagttgtttttgtatatttaaatgcttacctttattttttgtaaagtgcagcatactcatttgtgtataatcttactgatcagatgtttaaaattattccaaatacttcattaaaataattattttattataagaaaaaaaaaaaaaaaaaaaaaaaaaaaa

SEQ ID NO: 222 - DNA, 2371 bp, Homo sapiens
attttacaaccccaacgaggtgggccatggagtgccccgagggacagctccccatttcttcagaaaatgattcaacaccaacagtttcaacatcggaagtaactagccaacaagaaccccaaattcttgtcgaccgtgggtctgaaaccacctatgaaagcagcgccgacattgctggcgacgaaggcacccagattcctgccgacgaggacactcaaacggatgcggacagcagcgcccaggctgctgcccaggccccagaaaacttccaggaagggaaagacatgagtgaaagccaggatgaagttcctgatgaagttgagaaccagtttatattgcgtctgcctctggaacatgcttgtactgtcaggaacctagcacgttctcaaagtgtcaagatgaaggataaactaaaaattgacttattgcctgatgggcgccatgcagttgttgaagtagaagatgtcccactagctgctaagctggttgacttgccttgtgttattgaaagcctgagaacgcttgataaaaaaaccttttataaaacagcagacatttctcagatgcttgtgtgcactgctgatggtgatatccacctttctccagaagaaccagctgcctctactgatcctaatatagtcaggaaaaaagaaagggggagagaagaaaaatgtgtctggaagcatggcattacgccaccacttaagaatgtcagaaagaaaaggttccggaaaacacaaaaaaaggtccctgatgtcaaagaaatggaaaaaagcagctttactgagtacattgaatctccagacgtggaaaatgaagtaaagagactgctgcgttcggatgctgaagccgtaagtacccgttgggaagtcattgctgaagatggaaccaaggaaatagaaagtcaaggctccatcccaggatttttgatatcctcgggaatgagcagccacaagcagggtcatacctcgtcagaatatgatatgcttcgggagatgttcagtgattctagaagtaacaatgatgatgatgaggatgaggatgatgaagatgaggatgaggatgaggatgaggatgaagatgaagacaaagaagaggaggaggaagattgttctgaagagtatctggaaaggcagctgcaggccgagtttattgaatctggccagtatagggcaaatgaaggtaccagttcaatagtcatggaaattcagaagcagattgagaaaaaggagaaaaagctccataagattcagaataaagcacaaagacagaaggatctcatcatgaaagtggaaaacctgacactcaagaatcattttcagtctgtgctggagcagcttgagttacaggaaaaacaaaaaaatgagaagctcatttccctacaggaacagttgcagcgttttctgaagaagtgaggagagccattggcgtggcccacaaaccttggattcaccatccagactgcagattggatgaaactgtgcacgtttttgtcccttcagttgccttatgttgaatcagttatatttatctgtaccttctttgctacttaaaatatgctcacagtttgtagtcatgtagaaaaggccagtataaaaatgtagtagacttaaagaccccactcgaccatgagactttctctttgtcaatttgggaattattattattaatttagaaatggggtcttgttatgttgcccaggctgaattcagactcctgggcttaagggatccttccgcctcagcctcctgagtagctgggactacagttgtgcaccaccacaccaaacaagaattgattatattgcttctgtgctatggtaccagcagattattcagccatgcttctaaaggcagtctagcctagaggccgtacagctgtttggtttgcatatgttttagcttttcttttggtttttagtatttcctaaaacataggggaaaaaacgaggtcatttctactaagcactaggacctgccatagtgagtttaagtgcctaccttgcagcagttaatactagattgtgttctgtctctgttcaggtaacaggactgcattcctgctcaaggatgattccttgctgctgcttatgttctgttgtttttaggatggagctggttgttattcaccaactaagggaacagttagagcagagatgaagaaattatgaactgttatccttattctgagccttctcctcctaaccctcatcagttaaggttaggaagaacaagatgccataatgcctatgaagacttctttaacaatcttgtttgggtttttttctaggtatattattagtgttttatggtctatgttctttaagcaataaataaattgttcattttaaatggaaaaaaaaaaaaaaaaa

SEQ ID NO: 223 - DNA, 2203 bp, Homo sapiens
agcgttcgcctctacgttccgcgcgggagcccacgcgcggttcgtccggaacccacagaccagagacgcaggtcccagccttttcggtgtcggcgccagttcccggaggagcggacatgagtgaaagccaggatgaagttcctgatgaagttgagaaccagtttatattgcgtctgcctctggaacatgcttgtactgtcaggaacctagcacgttctcaaagtgtcaagatgaaggataaactaaaaattgacttattgcctgatgggcgccatgcagttgttgaagtagaagatgtcccactagctgctaagctggttgacttgccttgtgttattgaaagcctgagaacgcttgataaaaaaaccttttataaaacagcagacatttctcagatgcttgtgtgcactgctgatggtgatatccacctttctccagaagaaccagctgcctctactgatcctaatatagtcaggaaaaaagaaagggggagagaagaaaaatgtgtctggaagcatggcattacgccaccacttaagaatgtcagaaagaaaaggttccggaaaacacaaaaaaaggtccctgatgtcaaagaaatggaaaaaagcagctttactgagtacattgaatctccagacgtggaaaatgaagtaaagagactgctgcgttcggatgctgaagccgtaagtacccgttgggaagtcattgctgaagatggaaccaaggaaatagaaagtcaaggctccatcccaggatttttgatatcctcgggaatgagcagccacaagcagggtcatacctcgtcagaatatgatatgcttcgggagatgttcagtgattctagaagtaacaatgatgatgatgaggatgaggatgatgaagatgaggatgaggatgaggatgaggatgaagatgaagacaaagaagaggaggaggaagattgttctgaagagtatctggaaaggcagctgcaggccgagtttattgaatctggccagtatagggcaaatgaaggtaccagttcaatagtcatggaaattcagaagcagattgagaaaaaggagaaaaagctccataagattcagaataaagcacaaagacagaaggatctcatcatgaaagtggaaaacctgacactcaagaatcattttcagtctgtgctggagcagcttgagttacaggaaaaacaaaaaaatgagaagctcatttccctacaggaacagttgcagcgttttctgaagaagtgaggagagccattggcgtggcccacaaaccttggattcaccatccagactgcagattggatgaaactgtgcacgtttttgtcccttcagttgccttatgttgaatcagttatatttatctgtaccttctttgctacttaaaatatgctcacagtttgtagtcatgtagaaaaggccagtataaaaatgtagtagacttaaagaccccactcgaccatgagactttctctttgtcaatttgggaattattattattaatttagaaatggggtcttgttatgttgcccaggctgaattcagactcctgggcttaagggatccttccgcctcagcctcctgagtagctgggactacagttgtgcaccaccacaccaaacaagaattgattatattgcttctgtgctatggtaccagcagattattcagccatgcttctaaaggcagtctagcctagaggccgtacagctgtttggtttgcatatgttttagcttttcttttggtttttagtatttcctaaaacataggggaaaaaacgaggtcatttctactaagcactaggacctgccatagtgagtttaagtgcctaccttgcagcagttaatactagattgtgttctgtctctgttcaggtaacaggactgcattcctgctcaaggatgattccttgctgctgcttatgttctgttgtttttaggatggagctggttgttattcaccaactaagggaacagttagagcagagatgaagaaattatgaactgttatccttattctgagccttctcctcctaaccctcatcagttaaggttaggaagaacaagatgccataatgcctatgaagacttctttaacaatcttgtttgggtttttttctaggtatattattagtgttttatggtctatgttctttaagcaataaataaattgttcattttaaatggaaaaaaaaaaaaaaaaa

SEQ ID NO: 224 - DNA, 3389 bp, Homo sapiens
gttctgcaagagctggaagctccagttggggtaaggaggctcccatcccgagcttgcgtagtggttctgtgtggcgctgaggaatttggaaacctcaaatggctaaactattacaacctccacccaagttcctgccctcagagtggcacattgctaacaagaaccagtaccacagagcagacgctcaaaggtcccgatcagaacgcctggtcgcagaaagccagaggcttgtggatgaaattgaaaagaccacaagaaaatctcaaagcgatgtgaacaagaaactagaacagagactcgaggaagtccagttctggaagaaggagttagatgacaaacttgagcagcttgtgaatgtaactgatgatctactcatatataagatcagattggaaaaagccctggagaccttgaaagagcccttgcacatcactgagacatgcctggcatacagggagaagcgcattggcattgacctggtgcacgacacagtggagcatgagctgataaaggaggctgagatcatccagggcattatggctctgctgacccgtaccttggaggaggcttccgagcagattcggatgaaccgctctgccaagtacaatcttgagaaggatttgaaggacaagtttgtggccctgaccatagatgatatctgcttctcgctcaacaacaactcaccaaacatcagatattctgagaacgccgtgaggattgagccaaactccgtgagtctggaagactggttggacttctccagcaccaatgtggagaaggctgacaagcagcggaacaactccctgatgctgaaagccctggtggatcgaatcctgtcccagacagccaatgatctgcgcaagcagtgtgatgtggtggacacggcattcaagaatgggctgaaggatacaaaggatgccagggacaagctggctgatcatctggccaaggtcatggaagagattgcttcccaggagaaaaatattacagctcttgaaaaggccatccttgaccaagaagggccagccaaggtggctcatacgcgcttggagaccaggacacaccggccgaacgtggagctgtgtcgtgatgtcgcacaatataggctaatgaaggaggttcaagagatcacccacaatgtcgcaagattgaaggaaactttagcccaagctcaggcagagctgaaagggctgcatcgcagacagcttgccctgcaggaggagatccaggtcaaagagaacaccatttatatcgacgaagtgctgtgtatgcagatgaggaaatccatcccacttcgggatggggaagaccatggggtctgggctgggggcctccgccctgatgctgtctgctaatagtagggctagttccaattctcattaaaccacattgtaaacagtagttacagtagtacagagctctcatttcaggctggcggggcctctagccagcctgctgcaacctcttggctggcattccaagcctgctcagggggctgattttggggcgagtttcttctcttatgctggtgtggtgtttgcctaacaattcaactccatattttagcacaggccactcttacaatatcacaggacttggggccccaggacagggtttcaagacatttcagttcagattcaattcaataaagtagttgggctggatcacctgtgtagaccatgcccctcttgctcatgagatgggatgctaacctttctcttggctctcaaaatttcttttctctagaaaataatgtgttttttttctcttaaatactcaaataacataaagaaaaagaacaaaattccattcattcaagtcaatgggttcaagtcaatggttaagactgtaggttccggagtctgccatctgagtataggacctccaatagtccccactcacagggctataggggcgttgaatgagatcacctccgtaaagggcttcatactgagcctgtatcatggggcagtgagtgtttaatgaatgtgagccattgtgagcagtcccaccctataccaacataatttctgcacaattgtactcatggcataaactcaatttcaggattatttttttccttcactgctaattattgcaagcctttgttcatgttgctaaattgtctttataattattttaatggttacgtacctctttacaagttttcagcaagactgttttatatacttactgtttcttttccaaaaagagttcaacttgtgggaggctgccttccgctgagctgcagcaggtcagagatctatgtgggtgactgtcaaaggaagacatttgctgtgggaaactgctcatttgttccttattccgctaacattgaaggaacactttccatggacgaggcttaccatctcagcaccctcccatgtgtgaagctgctgctacactctgctaacatttggttccccggtgctcatggacagctgacggtgtggggctcaggagacctagcttctagttgcaacactgccaggaaagtttctctccttctttaggaccacctgtaaagtaaggaaaggactatatcgtctggaactcttcctgtccttgctgttccctgaatctggctgtctagctgcacatacggtgtcatagggcacaatgataatgcagagtgtgggcctaattcctgggagctttgcaatctaggtgctccttggtccagagactctttgccatcagaaagggatgttcccaatctgggatggagaaaccccctttgaggccaaaagcactggcttaattctgttaattctgatctatgccaccccagtgctgaacgtctcctctcagagtgctcagcaaatacacagcccttcccatgcctcaatcaaggagggaggcccctctctgctcactgggaagcctctgggtgcttttctgctctggctcggaagagtccaaataagccttcccagctcactgggcagacctcagagtttctgctaacttagcagggttttgaggtctgtcccagaggatgtggctggcagggtgtgaagacactgggcaaaatccttccttgtgaatacagctctcagaggcagccagcctcagtggtggattcagatcccaggctctgcagggagatgtgattcagatcagctggtggatcagctccacgctctacctgtgatgtgatccccgccaagttactcaacttccccgagcttcagttgcctaatctgtaaataagactaataaagcctagattggcgagataacgtgtggaagactctcaacacagtgtctggaacatgctgcttttaagggaaatgtgattttgattatggttgaggccatttctcaacatgtagacataaaatgcggaaacatctaagatttcaataaagcaatgttttgttagtaaa

SEQ ID NO: 225 - DNA, 4766 bp, Homo sapiens
ctgcgcagtctgaggcgtccctcgcgtcgggtggaagagcggctgcgcaacaagtgaacctatggattaaggtgtagccgggcggcccggaggttgagagtgcaagattattctgcgcctgcgcggcccgggtaactttgctggctgctcctaggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcaatcatttccatgtctttgttggtgatctcagcccagaaattacaactgaagatataaaagctgcttttgcaccatttggaagaatatcagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgttttctataacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 226 - DNA, 4634 bp, Homo sapiens
gccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaagatcatttccatgtctttgttggtgatctcagcccagaaattacaactgaagatataaaagctgcttttgcaccatttggaagaatatcagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgttttctataacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 227 - DNA, 4796 bp, Homo sapiens
ctgcgcagtctgaggcgtccctcgcgtcgggtggaagagcggctgcgcaacaagtgaacctatggattaaggtgtagccgggcggcccggaggttgagagtgcaagattattctgcgcctgcgcggcccgggtaactttgctggctgctcctaggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaagatcatttccatgtctttgttggtgatctcagcccagaaattacaactgaagatataaaagctgcttttgcaccatttggaagaatatcagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgttttctataacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 228 - DNA, 619 bp, Homo sapiens
gtaaagctaggcctgctgggagaggatgaggaggaggccctgcccctccaaacgtggcctcctatggacacccagactcacagccttcctatcacccacactcagctccatagcaactctcagccccaaagccgcacctgcacccgccattgccaaaccttcagccagagttgcagacagagccatcgtggcagccggagccagagctccagccagagcccggccagccaccgcaacccaactggagcccacagctcatccggccaccagagccagagtcccaacactagtccaccaccaaagcgccacaaaaagactatgaactcccaccactctcccatgcggcccaccatcctgcactgccgctgccccaagaacagaaagaacttggaaggcaagctgaaaaagaaaaaaatggccaagaggatccagcaggtgtacaaaaccaagacgcggagctcaggatggaaatccaactaatgagaccgcactccttggcttgttcctgcgtgtttcacccaaaggagaaaatgctaggatgaagtcaatcttcttgcaggaacatgttactatggtgatttctacgcaacactaattaaagcttgtacctggaagacta

SEQ ID NO: 229 - DNA, 1385 bp, Homo sapiens
agcgcggcgcgggggaggcacggctggaagaggcagtcaatcgctgggtgctcaagttctacttccacgaggcgctgcgggcctttcggggtagccggtacggggacttcagacagatccgggacatcatgcaggctttggttgtcaggcccttggggaaggagcacaccgtgtcccgattgctgcgggttatgcagtgtctgtcgcggattgaagaaggggaaaatttagactgttcctttgatatggaggctgagctcacaccactggaatcagctatcaatgtgctggagatgattaaaacggaatttacactgacagaagcagtggtcgaatccagtagaaaactggtcaaggaagctgctgtcattatttgtatcaaaaacaaagaatttgaaaaggcttcaaaaattttgaaaaaacatatgtccaaggaccccacaactcagaagctgagaaatgatctcctgaatattattcgagaaaagaacgtggcccatcctgttatccagaacttttcatatgagaccttccagcagaagatgctgcgcttcctggagagccacctggatgacgccgagccctacctcctcacgatggccaaaaaggctttgaaatctgagtccgctgcctcaagtacagggaaggaagataaacagccagcaccagggcctgtggaaaagccacccagagaacccgcaaggcagctacggaatcctccaaccaccattggaatgatgactctgaaagcagctttcaagactctgtctggtgcacaggattctgaggcagcctttgcaaaactggaccagaaggatctggttcttcctactcaagctctcccagcatcaccagccctcaaaaacaagagacccagaaaagatgaaaacgaaagttcagccccggctgacggtgagggtggctcggaactgcagcccaagaacaagcgcatgacaataagcagattggtcttggaggaggacagccagagtactgagcccagcgcaggcctcaactcctcccaggagaccgcttcagcgccaccatccaagcccaccgttctcaaccaacccctccctggagagaagaatcccaaagtacccaaaggcaagtggaacagctctaatggggttgaagaaaaggagacttgggtggaagaggatgaactgtttcaagttcaggcagcaccagatgaagacagtacaaccaatataacaaaaaagcagaagtggactgtagaagaaagcgagtgggtcaaggctggagtgcagaaatatggggaaggaaactgggctgccattactaaaaattacccatttgttaaccgaacagctgtgatgattaaggatcgctggcggaccatgaaaagacttggcatgaactga

SEQ ID NO: 230 - DNA, 1304 bp, Homo sapiens
atggcctctgcgccctggccggagcgggttccgaggctgctcgctccgcgcttaccctcttacccgcccccacccccaacagtgggattacggtccatggagcaggaggagacctacctggagctctacctggaccagtgcgccgctcaggatggccttgccccacccaggtctcccctgttcagcccagttgtaccttatgatatgtacatactgaatgcatccaatccggatactgcatttaattcgaaccctgaagtcaaagaaacatctggtgatttctcatctgtggatcttagcttcctaccagatgaagttacccaggaaaataaagaccagcctgtcattagcaaacacgaaactgaagaaaattctgaaagccaaagtccacaaagtaggttgccatcacccagcgaacaggacgttgggctgggcttaaacagcagcagtttgtcaaattcccattcacagctgcaccctggtgatactgactcagtccagccctctcctgagaaaccaaactccgactccttgtctctggcatccataactcccatgacaccaatgacccctatttcagaatgttgtggaattgtacctcaactacagaatatagtttccactgtaaacctggcctgtaagttggatctgaagaaaatagctttgcatgcaaaaaatgcagaatataacccaaagaggtttgctgctgtcataatgaggatccgagagcccaggacaacagcccttatatttagctctgggaagatggtctgcacgggagccaaaagtgaagagcagtctcgacttgcagcaagaaaatatgctcgtgtggtgcagaagcttgggttccctgccagattcctcgattttaaaattcagaacatggttggaagctgtgatgtgagatttcccatcaggctggaaggtttggtgctaacccatcagcagttcagtagttacgagcctgaactgtttcctggtcttatttatagaatggtaaaaccacgaattgtgttgcttatctttgtatctggaaaagttgtgttgacaggtgccaaagaacgttctgagatctatgaagcatttgaaaacatctatcctattctaaaaggttttaaaaaagcctgagcatatcattcagcatctcacattattctggtttgaatatgtccataagcccagcacagaaacagctggattcttctacgtttaattgtagatgttacaagtacgttacttattaaagggcgactctgtgtaagtaacctaagaaacgaagaaaaattcttatycaaaaaaaaaaa

SEQ ID NO: 231 - DNA, 1216 bp, Strongylocentrotus purpuratus
ttgtagaaggtctctccgcttctctgcaatactaccaagcatcctacagctcaaccatgcagtctctcatcgctttcttggccgtccttgtcggggtagccgtcgcccacccgatggttctctcgcccgccgaacagaaccagcagaacaaagatatctcggccaaggagttcctgaagaagatgttcccggcggactcgacggtgtcctccatccgaagcgacaatcaagtggatgaggacatcgttcaacagctacgggctctggggcttcgtgaggcagcgaacatttccgagcaggttgacctgaggcaggttctccgagacagtgacctttcatctgtcacattgtgcatgcccagtgacaaggctgtccaaaagtggaggcaggagcttcctgctaagctgaggccagaccaggaggccatgaggaacctggtcaaggcttgggccgtttcaggaagggtcgagtcttcgcagatcaccgacaaccagaaggtccagagtctgaacggcgccaagctaagattcaacgtctaccgtgactcgaaaaagatgatcaccgttaatggcgctcgagtcattgacgccgacaggaatgctagcagtggactcgtccacgtagtcgacaaggtcatctatccactcccagtcggtaacgtaatggagaccctggatgataatcaagccttctccatcgtcgtcgatctcctgaaacaagccggactcgaagatgaacttagaaattctgaccccatcacggttcttgtgccgaccaacgccgctttccaagccctcccatccggggtcctcgacgacctcaaaaaggataccgccggcaaactccggaacctgctcaagtaccacgtgatctctgacgtcaagtattctgcctctttgaagtctggtcagcgcctccgtgcctcgcagggagatgagatttcggttgcccgcgacagtgatgatcaaattctcctgaacaagcatagtgaccagtcaaaagcttcccgggtgatcctacgcgatatccccacaaccaatggagtgattcaggtcgtcgaccgggtcattctcccgtcacaaaaacacttcgttctagtttaaaaaactggacgacccggttcccgatacagcccatacgatatggacttattatcagaatattaattgaatgtcgtgatacaatcatgaatctgtatttttagtacggaaataaa

SEQ ID NO: 232 - DNA, 2321 bp, Mus musculus
ggggcggggctctgacgcgcttccggtggtgctgtcgttcagccgctgtgaggattccagactccaaagcggttctgagtcacggtgagcctgcgagtcccagtgctgtaattacaggtatgcaccaccacgacttcagcttggagtttccaagtgcagagtgtcttaagggcattatctactacaaggtttgaagagtggcactttaagaaccagaaacccaaaggtaccaggtctactcctaaaagtcctgctggctcgggaatctgtgatgactaaggtggtgggcatggccacagttctgggccccaggccacctcaggaatctatgggaccttcgcccattaaagtagaagaggatgaagagaaagacaagtgctgccctaccctagagctatcccataagcacttcagacagtctgggaaccaagatacccttgagccaatgggtccttcgaccattaaagctgaagaggatgaaagcaaagacaagtgccgccctaacctagagatatcccgtaagagcttcaagcagtttgggtaccaagacactcttgagcagttgggaccttcgaccattaaagctgaagaggatgatgagaaggataagggccaccctagcccagagatatctcgacagcgcttcaggcaatttgggtaccatgacactcctgggccccgagaggcactgagccagcttcgggtgctctgctgtgagtggctacagcccgagatccacaccaaagagcagattctagagctactggttctggagcagttcctgaccatcctgccccgagagctccagacctgggtacagcagcactgccctgaaagtgcagaggaggccgtcactctcctggaagacctggagcaagaacttgatgagccaggactgcaggtctcatctcctccaaatgaacagaagcagtcttgggagaaaatgtcaacttcaggaacggcaatggagtccttaagcagtactgagacccaacatgtggatgccagccctaaatatgagttttgggggcccctgtacatccaagagactggtgaggaggaggtttttactcaggatccaagaaagcgccaaggttttaaatcgaatccccagaaggaggactcagcagatgagcacagaagttctgaagaagagtctcatgcagacggactcaaaagaaccgtcatccccatgattcctgccaataagtatgggtcacggtcagaaaggcagtgggccaacaacctggagagggagagagggacaaaagcctctcttcaagacacaggttccaggaaaggggcagagccagcgtctactaggcctgccccaggagagaaacgttacatatgtgcagagtgtgggaaggcctttagcaatagctcaaacctcactaagcaccggagaacacacactggggagaagccttatgtgtgtacaaagtgtgggaaggctttcagccacagctccaaccttacccttcattaccgaactcacctggtggaccggccctatgactgtaagtgtgggaaagcctttgggcagagctcagacctccttaaacatcaaaggatgcacacggaagaggcgccctatcagtgtaaagactgtgggaaagcctttagtgggaagggcagcctcattcgacactatcgcatccacacaggggagaagccctatcagtgtaatgagtgtggaaagagttttagtcagcatgcaggtctcagttctcatcagcgtctgcatacaggggagaaaccctataagtgtaaggagtgtggcaaagccttcaaccatagttcaaattttaataagcatcatagaatccatactggcgaaaagccctattggtgtagccactgtgggaaaaccttctgtagcaagtccaatctgtccaagcatcagagagttcacactggagagggagaagtccagtaacggtccattctcgtctgttgttctcgttgtaaacgttagaatgcgaatgctaggaagaagctctgtaatgcatttgatgtttgatagtaggttttgctgtagtcatcaagggtgccttggagggagagctacacagtgatagagcagacaggaggtctacagaggagcagggagctccacacactccaggccccagtgtactgtgtgtccagtatagttaaggaagaaacattaaaattgtttaactgttttaacatgtatcccacagttgtagtttgtaaagaattgagccaccttgaacagtctgattcagaataaacgtatagcatcatgtagcgtctcaggactgttattgtgataaacaatgttgctataaaacttg

SEQ ID NO: 233 - DNA, 2236 bp, Mus musculus
ggggcggggctctgacgcgcttccggtggtgctgtcgttcagccgctgtgaggattccagactccaaagcggttctgagtcacggtgagcctgcgagtcccaggtttgaagagtggcactttaagaaccagaaacccaaaggtaccaggtctactcctaaaagtcctgctggctcgggaatctgtgatgactaaggtggtgggcatggccacagttctgggccccaggccacctcaggaatctatgggaccttcgcccattaaagtagaagaggatgaagagaaagacaagtgctgccctaccctagagctatcccataagcacttcagacagtctgggaaccaagatacccttgagccaatgggtccttcgaccattaaagctgaagaggatgaaagcaaagacaagtgccgccctaacctagagatatcccgtaagagcttcaagcagtttgggtaccaagacactcttgagcagttgggaccttcgaccattaaagctgaagaggatgatgagaaggataagggccaccctagcccagagatatctcgacagcgcttcaggcaatttgggtaccatgacactcctgggccccgagaggcactgagccagcttcgggtgctctgctgtgagtggctacagcccgagatccacaccaaagagcagattctagagctactggttctggagcagttcctgaccatcctgccccgagagctccagacctgggtacagcagcactgccctgaaagtgcagaggaggccgtcactctcctggaagacctggagcaagaacttgatgagccaggactgcaggtctcatctcctccaaatgaacagaagcagtcttgggagaaaatgtcaacttcaggaacggcaatggagtccttaagcagtactgagacccaacatgtggatgccagccctaaatatgagttttgggggcccctgtacatccaagagactggtgaggaggaggtttttactcaggatccaagaaagcgccaaggttttaaatcgaatccccagaaggaggactcagcagatgagcacagaagttctgaagaagagtctcatgcagacggactcaaaagaaccgtcatccccatgattcctgccaataagtatgggtcacggtcagaaaggcagtgggccaacaacctggagagggagagagggacaaaagcctctcttcaagacacaggttccaggaaaggggcagagccagcgtctactaggcctgccccaggagagaaacgttacatatgtgcagagtgtgggaaggcctttagcaatagctcaaacctcactaagcaccggagaacacacactggggagaagccttatgtgtgtacaaagtgtgggaaggctttcagccacagctccaaccttacccttcattaccgaactcacctggtggaccggccctatgactgtaagtgtgggaaagcctttgggcagagctcagacctccttaaacatcaaaggatgcacacggaagaggcgccctatcagtgtaaagactgtgggaaagcctttagtgggaagggcagcctcattcgacactatcgcatccacacaggggagaagccctatcagtgtaatgagtgtggaaagagttttagtcagcatgcaggtctcagttctcatcagcgtctgcatacaggggagaaaccctataagtgtaaggagtgtggcaaagccttcaaccatagttcaaattttaataagcatcatagaatccatactggcgaaaagccctattggtgtagccactgtgggaaaaccttctgtagcaagtccaatctgtccaagcatcagagagttcacactggagagggagaagtccagtaacggtccattctcgtctgttgttctcgttgtaaacgttagaatgcgaatgctaggaagaagctctgtaatgcatttgatgtttgatagtaggttttgctgtagtcatcaagggtgccttggagggagagctacacagtgatagagcagacaggaggtctacagaggagcagggagctccacacactccaggccccagtgtactgtgtgtccagtatagttaaggaagaaacattaaaattgtttaactgttttaacatgtatcccacagttgtagtttgtaaagaattgagccaccttgaacagtctgattcagaataaacgtatagcatcatgtagcgtctcaggactgttattgtgataaacaatgttgctataaaacttg

SEQ ID NO: 234 - DNA, 2302 bp, Mus musculus
ggggcggggctctgacgcgcttccggtggtgctgtcgttcagccgctgtgaggattccagactccaaagcggttctgagtcacgtgctgtaattacaggtatgcaccaccacgacttcagcttggagtttccaagtgcagagtgtcttaagggcattatctactacaaggtttgaagagtggcactttaagaaccagaaacccaaaggtaccaggtctactcctaaaagtcctgctggctcgggaatctgtgatgactaaggtggtgggcatggccacagttctgggccccaggccacctcaggaatctatgggaccttcgcccattaaagtagaagaggatgaagagaaagacaagtgctgccctaccctagagctatcccataagcacttcagacagtctgggaaccaagatacccttgagccaatgggtccttcgaccattaaagctgaagaggatgaaagcaaagacaagtgccgccctaacctagagatatcccgtaagagcttcaagcagtttgggtaccaagacactcttgagcagttgggaccttcgaccattaaagctgaagaggatgatgagaaggataagggccaccctagcccagagatatctcgacagcgcttcaggcaatttgggtaccatgacactcctgggccccgagaggcactgagccagcttcgggtgctctgctgtgagtggctacagcccgagatccacaccaaagagcagattctagagctactggttctggagcagttcctgaccatcctgccccgagagctccagacctgggtacagcagcactgccctgaaagtgcagaggaggccgtcactctcctggaagacctggagcaagaacttgatgagccaggactgcaggtctcatctcctccaaatgaacagaagcagtcttgggagaaaatgtcaacttcaggaacggcaatggagtccttaagcagtactgagacccaacatgtggatgccagccctaaatatgagttttgggggcccctgtacatccaagagactggtgaggaggaggtttttactcaggatccaagaaagcgccaaggttttaaatcgaatccccagaaggaggactcagcagatgagcacagaagttctgaagaagagtctcatgcagacggactcaaaagaaccgtcatccccatgattcctgccaataagtatgggtcacggtcagaaaggcagtgggccaacaacctggagagggagagagggacaaaagcctctcttcaagacacaggttccaggaaaggggcagagccagcgtctactaggcctgccccaggagagaaacgttacatatgtgcagagtgtgggaaggcctttagcaatagctcaaacctcactaagcaccggagaacacacactggggagaagccttatgtgtgtacaaagtgtgggaaggctttcagccacagctccaaccttacccttcattaccgaactcacctggtggaccggccctatgactgtaagtgtgggaaagcctttgggcagagctcagacctccttaaacatcaaaggatgcacacggaagaggcgccctatcagtgtaaagactgtgggaaagcctttagtgggaagggcagcctcattcgacactatcgcatccacacaggggagaagccctatcagtgtaatgagtgtggaaagagttttagtcagcatgcaggtctcagttctcatcagcgtctgcatacaggggagaaaccctataagtgtaaggagtgtggcaaagccttcaaccatagttcaaattttaataagcatcatagaatccatactggcgaaaagccctattggtgtagccactgtgggaaaaccttctgtagcaagtccaatctgtccaagcatcagagagttcacactggagagggagaagtccagtaacggtccattctcgtctgttgttctcgttgtaaacgttagaatgcgaatgctaggaagaagctctgtaatgcatttgatgtttgatagtaggttttgctgtagtcatcaagggtgccttggagggagagctacacagtgatagagcagacaggaggtctacagaggagcagggagctccacacactccaggccccagtgtactgtgtgtccagtatagttaaggaagaaacattaaaattgtttaactgttttaacatgtatcccacagttgtagtttgtaaagaattgagccaccttgaacagtctgattcagaataaacgtatagcatcatgtagcgtctcaggactgttattgtgataaacaatgttgctataaaacttg

SEQ ID NO: 235 - DNA, 1972 bp, Homo sapiens
gggtgtgtctgtggcgtctcatggcaggaggctcagccacgacctggggttaccctgtggccctgctactgctggttgccaccctggggctgggtaggtggctccagcccgaccctggcctcccaggcctccggcacagctacgactgtgggatcaagggaatgcagctgctggtgttccccaggccaggccagactctccgcttcaaggtggtggatgaatttgggaaccgatttgatgtcaacaactgctccatctgctaccactgggtcacctccaggccgcaggagcctgcagtcttctcggccgattacagaggctgccacgtgctggagaaggatgggcgtttccacctgagggtgttcatggaggctgtgctgcccaatggtcgtgtggatgtggcacaagacgctactctgatctgtcccaaacctgacccctcccggactctggactcccagctggcaccacccgccatgttctctgtctcaaccccacaaaccctttccttcctccccacctctggccatacctcccaaggctctggccatgcctttcccagcccactggacccagggcacagctctgtccacccaacccctgctttaccatcccctggacctggacctaccctcgccaccctggctcaaccccactggggcaccttggaacactgggatgtgaacaaacgagattacataggtacccacctgagccaggagcagtgccaggtggcctcagggcacctcccctgcatcgtgagaagaacttcaaaagaagcctgtcagcaggctggctgctgctatgacaacaccagagaggttccctgttactatggcaacacagctactgtccagtgcttcagagatggctacttcgtcctcgtggtgtcccaagaaatggccttgacacacaggatcacactggccaacatccacctggcctatgcccccaccagctgctccccaacacagcacacggaagctttcgtggtcttctacttccctctcacccactgtggaaccacaatgcaggtggctggcgaccagctcatctatgagaactggctggtgtctggcatccacatccaaaaggggccacagggttccatcacgcgggacagcaccttccagcttcatgtgcgctgtgtcttcaacgccagtgacttcctgcccattcaggcatccattttcccacccccatcgcctgctcctatgacccagcccggccccctgcggcttgagctgcggattgccaaagacgagaccttcagctcgtactatggggaggatgactatcccatcgtgaggctgctccgagaaccagtccatgtggaggtccggcttctgcagaggacagaccccaacctggtcctgctgctgcaccagtgctggggcgctcccagtgccaaccccttccagcagccccagtggcccatcctgtcagacggatgccctttcaagggcgacagctacagaacccaaatggtagccttggacggggccacacctttccagtcgcactaccagcgattcactgttgctaccttcgccctcctggactcaggctcccagagagccctcagaggactggtttacttgttctgcagcacctctgcctgccacacctcagggctggagacttgctccactgcatgtagcactggcactacaagacagcgacgatcctcaggtcaccgtaatgacactgccaggccccaggacatcgtgagctctccggggccagtgggctttgaggattcttatgggcaggagcccacacttgggcccacagactccaatgggaactccagcctgagacctctcctttgggcggtccttttgctgccagctgttgccctggtccttgggtttggtgtctttgtgggcctgagccagacctgggcccagaagctctgggaaagcaacagacagtgaatgggcccaataaacaatcatttcaaacctactga

SEQ ID NO: 236 - DNA, 2749 bp, Homo sapiens
gtgtgatgttcccctccctgtgtccatgtgttctcattgttcagctcccacttataagtgagaacagaatgttaagaatcatttttgtaataactttagtttttcctacctcctgataggagacactgttttacggagcagctatttcttcctgtgttcaaagtcagttgctgaacagatggtagcttcctgcttttccggagcagaatcctagacatggatgctcctgggcccagagccatttgttcggtggctgtccccagcacaccacaggtctgggttagggcagctggcagaatacccggcgcaagctgtcaggaatcagaggccacttccttccccaatccttccgtttcagctgggagaatgggacaagattcaggtgcccccaatggggagagggtgtggatgcggctggcttcctgctataaaaacacagagcagcctaccctctacctggttgatctggtagtgtcttctgctatggcgtgcaggcagagaggaggctcttggagtccctcaggctggttcaatgcaggctggagcacctacaggtcgatttctctcttcttcgcccttgtgacttcagggaactccatagatgtttctcagttggtaaatcctgcctttccaggcactgtcacttgcgatgaaagggaaataacagtggagttcccaagcagtcctggcaccaagaaatggcatgcatctgtggtggatcctcttggtctcgacatgccgaactgcacttacatcctggacccagaaaagctcaccctgagggctacctatgataactgtaccaggagagtgcatggtggacaccagatgaccatcagagtcatgaacaacagtgctgccttaagacacggagctgtcatgtatcagttcttctgtccagctatgcaagtagaagagacccaggggctttcagcatctacaatctgccagaaggatttcatgtctttttccttgccacgggtcttctctggcttggctgacgacagtaaggggaccaaagttcagatgggatggagcattgaggttggtgatggtgcaagagccaaaactctgaccctgccagaggccatgaaggaaggcttcagcctcttgattgacaaccacaggatgaccttccatgtgccattcaatgccactggagtgactcactatgtgcaaggtaacagtcatctctacatggtgtctctgaagcttacatttatatctcctggacagaaggtgatcttctcttcacaagctatttgtgcaccagatcctgtgacctgcaatgccacacacatgactctcaccataccagagtttcctgggaagcttaagtctgtgagctttgaaaaccagaacattgatgtgagccagctgcatgacaatggaattgatctagaagcaacaaatggcatgaaattgcatttcagcaaaactctgctcaaaacgaaattatctgaaaaatgcctactccatcagttctacttagcttcactcaagctgacctttctccttcggccagagacagtatccatggtgatctatcctgagtgtctctgtgagtcacccgtttctatagttacaggggagctgtgcacccaggatgggtttatggacgtcgaggtctacagctaccaaacacaaccagctcttgacctgggtactctgagggtgggaaactcatcctgccagcctgtctttgaggctcagtctcaggggctggtacggttccacatacccctgaatggatgtggaacgagatataagttcgaagatgataaagtcgtctatgaaaacgaaatacatgctctctggacggattttcctccaagcaaaatatctagagacagtgagttcagaatgacagtgaagtgttcttatagcaggaatgacatgctactaaacatcaacgttgaaagccttactcctccagtggcctcagtgaagttgggtccatttaccttgatcctgcaaagctacccagataattcctaccaacaaccttatggggaaaacgagtaccctctagtgagattcctccgccaaccaatttacatggaagtgagagtcctaaacagggatgaccccaacatcaagctggtcttagatgactgctgggcgacgtccaccatggatccagactctttcccccagtggaacgttgtcgtggatggctgtgcatatgacctggacaactaccagaccaccttccatccagtcggctcctctgtgacccatcctgatcactatcagaggtttgacatgaaggcttttgcctttgtatcagaagcccacgtgctctctagcctggtctacttccactgcagtgccttaatctgtaatcgactctcccctgactccccactgtgttctgtgacctgccctgtgtcctctaggcacaggcgagccacaggggccactgaagcagagaaaatgacagtcagcctcccaggacccattctcctgttgtcagatgactcctcattcagaggtgtcggctcatctgatctaaaagcaagtgggagcagtggggagaagagtaggagtgaaacaggggaggaggttggctcacgaggtgctatggacaccaaagggcacaagactgctggagatgttggttccaaagctgtggctgctgtggctgcctttgcaggtgtggtggcaactctaggcttcatctactacctgtacgagaaaaggactgtgtcaaatcactaaatgggcttctaaataaagcagtcaaaat

SEQ ID NO: 237 - DNA, 2722 bp, Homo sapiens
gtgtgatgttcccctccctgtgtccatgtgttctcattgttcagctcccacttataagtgagaacagaatgttaagaatcatttttgtaataactttagtttttcctacctcctgataggagacactgttttacggagcagctatttcttcctgtgttcaaagtcagttgctgaacagatggtagcttcctgcttttccggagcagaatcctagacatggatgctcctgggcccagagccatttgttcggtggctgtccccagcacaccacaggtctgggttagggcagctggcagaatacccggcgcaagctgtcaggaatcagaggccacttccttccccaatccttccgtttcagctgggagaatgggacaagattcaggtgcccccaatggggagagggtgtggatgcggctggcttcctgctataaaaacacagagcagcctaccctctacctggttgatctggtagtgtcttctgctatggcgtgcaggcagagaggaggctcttggagtccctcaggctggttcaatgcaggctggagcacctacaggtcgatttctctcttcttcgcccttgtgacttcagggaactccatagatgtttctcagttggtaaatcctgcctttccaggcactgtcacttgcgatgaaagggaaataacagtggagttcccaagcagtcctggcaccaagaaatggcatgcatctgtggtggatcctcttggtctcgacatgccgaactgcacttacatcctggacccagaaaagctcaccctgagggctacctatgataactgtaccaggagagtgcatggtggacaccagatgaccatcagagtcatgaacaacagtgctgccttaagacacggagctgtcatgtatcagttcttctgtccagctatgcaagtagaagagacccaggggctttcagcatctacaatctgccagaaggatttcatgtctttttccttgccacgggtcttctctggcttggctgacgacagtaaggggaccaaagttcagatgggatggagcattgaggttggtgatggtgcaagagccaaaactctgaccctgccagaggccatgaaggaaggcttcagcctcttgattgacaaccacaggatgaccttccatgtgccattcaatgccactggagtgactcactatgtgcaaggtaacagtcatctctacatggtgtctctgaagcttacatttatatctcctggacagaaggtgatcttctcttcacaagctatttgtgcaccagatcctgtgacctgcaatgccacacacatgactctcaccataccagagtttcctgggaagcttaagtctgtgagctttgaaaaccagaacattgatgtgagccagctgcatgacaatggaattgatctagaagcaacaaatggcatgaaattgcatttcagcaaaactctgctcaaaacgaaattatctgaaaaatgcctactccatcagttctacttagcttcactcaagctgacctttctccttcggccagagacagtatccatggtgatctatcctgagtgtctctgtgagtcacccgtttctatagttacaggggagctgtgcacccaggatgggtttatggacgtcgaggtctacagctaccaaacacaaccagctcttgacctgggtactctgagggtgggaaactcatcctgccagcctgtctttgaggctcagtctcaggggctggtacggttccacatacccctgaatggatgtggaacgagatataagttcgaagatgataaagtcgtctatgaaaacgaaatacatgctctctggacggattttcctccaagcaaaatatctagagacagtgagttcaggaatgacatgctactaaacatcaacgttgaaagccttactcctccagtggcctcagtgaagttgggtccatttaccttgatcctgcaaagctacccagataattcctaccaacaaccttatggggaaaacgagtaccctctagtgagattcctccgccaaccaatttacatggaagtgagagtcctaaacagggatgaccccaacatcaagctggtcttagatgactgctgggcgacgtccaccatggatccagactctttcccccagtggaacgttgtcgtggatggctgtgcatatgacctggacaactaccagaccaccttccatccagtcggctcctctgtgacccatcctgatcactatcagaggtttgacatgaaggcttttgcctttgtatcagaagcccacgtgctctctagcctggtctacttccactgcagtgccttaatctgtaatcgactctcccctgactccccactgtgttctgtgacctgccctgtgtcctctaggcacaggcgagccacaggggccactgaagcagagaaaatgacagtcagcctcccaggacccattctcctgttgtcagatgactcctcattcagaggtgtcggctcatctgatctaaaagcaagtgggagcagtggggagaagagtaggagtgaaacaggggaggaggttggctcacgaggtgctatggacaccaaagggcacaagactgctggagatgttggttccaaagctgtggctgctgtggctgcctttgcaggtgtggtggcaactctaggcttcatctactacctgtacgagaaaaggactgtgtcaaatcactaaatgggcttctaaataaagcagtcaaaat

SEQ ID NO: 238 - DNA, 1315 bp, Homo sapiens
gaggcggctgcctgctgctctgcaggtaccatggagctgagctataggctcttcatctgcctcctgctctggggtagtactgagctgtgctacccccaacccctctggctcttgcagggtggagccagccatcctgagacgtccgtacagcccgtactggtggagtgtcaggaggccactctgatggtcatggtcagcaaagacctttttggcaccgggaagctcatcagggctgctgacctcaccttgggcccagaggcctgtgagcctctggtctccatggacacagaagatgtggtcaggtttgaggttggactccacgagtgtggcaacagcatgcaggtaactgacgatgccctggtgtacagcaccttcctgctccatgacccccgccccgtgggaaacctgtccatcgtgaggactaaccgcgcagagattcccatcgagtgccgctaccccaggcagggcaatgtgagcagccaggccatcctgcccacctggttgcccttcaggaccacggtgttctcagaggagaagctgactttctctctgcgtctgatggaggagaactggaacgctgagaagaggtcccccaccttccacctgggagatgcagcccacctccaggcagaaatccacactggcagccacgtgccactgcggttgtttgtggaccactgcgtggccacaccgacaccagaccagaatgcctccccttatcacaccatcgtggacttccatggctgtcttgtcgacggtctcactgatgcctcttctgcattcaaagttcctcgacccgggccagatacactccagttcacagtggatgtcttccactttgctaatgactccagaaacatgatatacatcacctgccacctgaaggtcaccctagctgagcaggacccagatgaactcaacaaggcctgttccttcagcaagccttccaacagctggttcccagtggaaggcccggctgacatctgtcaatgctgtaacaaaggtgactgtggcactccaagccattccaggaggcagcctcatgtcatgagccagtggtccacgtctgcttcccgtaaccgcaggcatgtgacagaagaagcagatgtcaccgtgggggccactgatcttcctggacaggagtggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaagaagaaa

We claim:

1. A method of cellular reprogramming for the interconversion of a differentiated or somatic cell of a first cell phenotype to at least one desired second, multipotent, pluripotent, self-renewing or differentiating phenotype, the method comprising:
   transfecting a nucleated cell, wherein one or more transfection step is performed in vitro or in vivo, and wherein said nucleated cell is transfected with: a) a nucleic acid, b) a vector, c) a vector comprising synthetic oligonucleotides, d) a vector for gene therapy, e) a virus, f) a polypeptide, g) a ribonucleic acid or h) a deoxyribonucleic acid encoding a polypeptide, and wherein said polypeptide is;
   i. one or more first polypeptide(s) selected from PRR+ Numb, Oct3/4, Sox2, Nanog and a polypeptide with LIF activity;
   ii. one or more second polypeptide(s) selected from PRR+ Numb, Oct4, Sox2, Nanog, Notch, Fgf4, Hoxb4, Lin28, Lif, Lifr, Cntf, Cardiotrophin, Osm, Osm-r, Il6, Il6r, Hyper Il6, Il-11, Gp130, Stat3, C-myc, and a polypeptide with Lif Activity;
   iii. one or more third polypeptide(s) selected from a short Numb isoform, Numblike, MyoD, myogenin, Myocardin, Ifrdl, Myf 5, Myf 6, Mef2, Gata 4, Gata 5, Gata 6, Sox9, CREB-binding polypeptide, Runx2, HNF-1, HNF-3, HNF-4, HNF-6, Nurr1, REN, Neurogenin1, Neurogenin2, Neurogenin3, Mash1, Phox2a, Phox2b, dHand, Gata3, Shh, FGF8, Lmx1b, Nkx2.2, Pet1, Lbx1, Rnx, PITX2, D1x2, D1x5, Ngn2, Ptx3, Gata2, REST4, Foxa2, Sox17, HLXB9, Runx1/AML, Pdxl, OLIGI, OLIG2, NOV(CCN3), and Zfp488; and/or
   iv. one or more fourth polypeptide(s) altering the amount, activity or antigenicity of a cellular protein.

2. The method of claim 1, further comprising
   growing the transfected cell in a first incubation step effective that the transfected cell grows at a first growth rate;
   differentiating the transfected cell in a second incubation step; and/or
   culturing the transfected cell in an environment selected from de-cellularized cadaveric tissue, a two-dimensional scaffold, a three-dimensional scaffold, and hanging drops.

3. The method of claim 2, wherein the transfected cell is grown in an environment selected from decellularized cadaveric tissue, a two-dimensional scaffold engineered to replicate tissue structure, a two-dimensional scaffold engineered to replicate an organ, a three-dimensional format, a three-dimensional scaffold engineered to replicate tissue structure, a three-dimensional scaffold engineered to replicate an organ, and an ink-jet style cartridge for subsequent placement of the transfected cell in a desired position utilizing ink-jet printer technology for tissue engineering.

4. The method of claim 2, further comprising isolating transfected cells, wherein transfected cells are isolated from the growth or differentiation medium after achieving a desired cell number and/or a desired state of differentiation.

5. The method of claim 4, further comprising administering the isolated transfected cells to an individual or a patient.

6. The method of claim 5 wherein the method is capable of reducing abnormal growth, proliferation or cancer.

7. The method of claim 2, wherein the a growth medium comprises one or more cytokines selected from EGF, IL-I, oncostatin, CNTF, soluble gp130, bFGF, steel factor, LIF, cardiotrophin, OSM, IL6, hyper IL6, and a cytokine having LIF activity; and/or a differentiation medium comprises an agent selected from the group consisting of retinoic acid, Neurotrophin 3 (NT 3), nerve growth factor (NGF), glial cell-line derived growth factor (GDNF), interferon (IFN-Y), hexamethylene bis acrylamide, dimethylsulfoxide, fetal bovine serum (FBS), normal bovine serum (NBS), vascular endothelial growth factor (VEGF), thrombopoietin, a colony stimulating factor, M-CSF (CSF-I), GM-CSF, IL-7, and cardiomyocyte conditioned medium.

8. The method of claim 1, further comprising
   assessing the transfected cell according to morphology, expression of cellular markers, transgenic markers, antibiotic markers, fluorescent markers, a marker gene encoded by a transgene expressing vector, an antibiotic resistance gene, a fluorescent protein gene, or a reporter gene under the control of a cell type specific promoter;
   cryopreserving the transfected cell, and/or
   transplanting the transfected cell to an individual or to a patient in need thereof, whereby a disorder or disease is retarded, ameliorated or treated.

9. The method of claim 1, wherein the vector comprises synthetic oligonucleotides directed against a HIV co-receptor, a decoy sequence, an HIV-2 RRE decoy sequence and/or an HIV-2 TAR decoy sequence, wherein the vector is capable of retarding HIV, SIV, or FIV infection.

10. The method of claim 1, wherein the synthetic oligonucleotides comprise miRNA, siRNA, or shRNA sequences directed against an HIV co-receptor, against CXCR4 and/or against CCR5.

11. The method of claim 1, wherein the nucleated cell is selected from the group of stem/progenitor cells and somatic cell types, said stem/progenitor cells comprising donor cells, autologous cells, HLA type compatible cells, reprogrammed cells, induced multipotent cells, induced pluripotent cells, cells derived from bone marrow, peripheral blood, placental blood, amniotic fluid, umbilical cord blood, banked sources cryopreserved sources, skin, adipose tissue, non-human embryo cells, hematopoietic cells, spermatogonia, primordial germ cells, leukocytes, lymphocytes, epithelial cells, buccal cheek cells, and genetically-modified cells.

12. The method of claim 1, wherein the nucleated cell is transfected with a vector encoding a second polypeptide, wherein the vector encoding said second polypeptide does not integrate into the genome of said cell, wherein the second polypeptide is selected from PRR+ Numb, Oct4, Sox2, Nanog, Notch, FGF4, HOXB4, LIN28, LIF, LIFR, CNTF, cardiotrophin, OSM, OSM-R, L6, IL6R, hyper IL6, IL-11, gp130, stat3, c-myc, and a polypeptide with LIF activity.

13. The method of claim 1, wherein the nucleated cell is transfected with a third one or more polypeptide, and/or with ribonucleic acids or deoxyribonucleic acids encoding one or more third polypeptides, wherein the one or more third polypeptide is selected from a short Numb isoform, Numb-like, MyoD, myogenin, Myocardin, Ifrd1, Myf 5, Myf 6, Mef2, Gata 4, Gata 5, and Gata 6, Sox9, CREB-binding polypeptide, Runx2, HNF-I, HNF-3, HNF-4, HNF-6, Nurr1, REN, Neurogenin1, Neurogenin2, Neurogenin3, Mash 1, Phox2a, Phox2b, dHand, Gata3, Shh, FGF8, Lmxlb, Nkx2.2, Pet1, Lbx1, Rnx, PITX2, Dlx2, Dlx5, Ngn2, Ptx-3, Gata2, REST4, Foxa2, Sox17, HLXB9, Runx1/AML, Pdxl, OLIG1, OLIG2, NOV(CCN3), and Zfp488, or said nucleic acid comprises antisense Hes1 RNA.

14. The method of claim 13, wherein the nucleated cell is transfected with a first polypeptide, or with one or more ribonucleic acids or deoxyribonucleic acids encoding a first polypeptide selected from PRR+ Numb, Oct3/4, Sox2 and Nanog; and wherein the nucleated cell is transfected with a second one or more polypeptide(s) and/or with one or more ribonucleic acids or deoxyribonucleic acids encoding the second one or more polypeptide(s) selected from PRR+ Numb, Oct4, Sox2, Nanog, Notch, LIN28, HoxB4, FGF4, LIF, LIFR, cardiotrophin, oncostatin, oncostatin receptor, IL6, hyper IL6, gp130, stat3, c-myc, CNTF, and a polypeptide with LIF activity.

15. The method of claim 1, wherein the vector encodes one or more polypeptide(s).

16. The method of claim 1, wherein the vector is capable of retarding HIV-I, HIV-2, and/or FIV infection and includes a decoy sequence, a synthetic oligonucleotide sequence(s) and a synthetic oligonucleotide sequences(s) directed against an HIV viral genomic sequence, a synthetic oligonucleotide directed against an HIV enzyme(s), and/or an a synthetic oligonucleotide directed against an HIV co-receptor(s).

17. The method of claim 1, wherein the nucleated cell is transfected only with a first polypeptide; or with one or more nucleic acids encoding one first polypeptide, wherein the one first polypeptide is Oct3/4; and/or only with a second one or more polypeptide, or with one or more nucleic acids encoding one or more second polypeptide selected from PRR+ Numb, Sox2, Nanog, Notch, LIN28, HoxB4, FGF4, LIF, LIFR, cardiotrophin, oncostatin, oncostatin receptor, IL6, hyper IL6, gp130, stat3, c-myc, CNTF, and a polypeptide with LIF activity.

18. The method of claim 1, wherein one or more transfecting steps comprises one or more of electroporation, a non-integrating vector, a nanocapsule, a nanovault, a cationic lipid, a liposome, or comprises avoiding retroviral/lentiviral integration or other random alteration of the genomes of the transfected cell.

19. The method of claim 1 wherein the transfected nucleic acid, vector, polypeptide, or nucleic acid encoding a polypeptide is one altering cellular differentiation, cellular protein antigenicity, neoplastic potential, the amount or activity of an enzyme, a cellular protein, a structural protein, a receptor protein, a signal transduction protein, a cellular transport protein, a membrane associated protein, an HLA type protein, a protein involved in DNA repair and chromosome maintenance; a protein involved in synapse formation and maintenance; a protein involved in neurite outgrowth or axon outgrowth and formation; a protein involved in cellular repair, a transcription factor protein, a cell fate determinant, a protein deficient in a patient or subject, telomerase, aspartoacyclase, hexosaminidase A (HEXA), hexosaminidase B (HEXB), HPRT, Huntingtin, galactosidase alpha (HLA), glucosidase beta acid (GBA), von Hippel Lindau tumor suppressor (VHL), Beta globin (HBB), NPC, and/or PARK.

20. The method of claim 1, wherein the nucleated cell is screened for HLA type and/or the transfected cell is screened for successful transfection, initiation of differentiation, or using standard PCR or nucleic acid hybridization-based methods.

21. The method of claim 1, wherein the transfected cell is genetically-modified.

22. The method of claim 1, wherein the nucleated cell is transfected simultaneously with two or more nucleic acids, two or more vectors, or two or more polypeptides.

23. The method of claim 1, wherein neoplastic potential is altered in the transfected cell.

24. The method of claim 1, wherein the transfected cell is capable of promoting growth in a target tissue, ameliorating a disease, ameliorating an injury or repairing a tissue.

25. The method of claim 1, wherein the method does not use oncogenes.

26. The method of claim 1, wherein the vector:
targets a sequence with at least 70% identity to a viral genomic nucleotide sequence or its complement; comprises synthetic oligonucleotide sequences that reduce the ability of target cells to sustain HIV replication by >70;
comprises synthetic oligonucleotide sequences that reduce HIV viral activity by >70%; and/or
comprises one or more synthetic nucleotide sequence comprising SEQ ID NO: 3, SEQ ID NO: 4, SEQ ID NO: 5, SEQ ID NO: 6, SEQ ID NO: 7, SEQ ID NO: 8, the nucleotides at positions 12-26 of SEQ ID NO: 8 SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, and/or SEQ ID NO: 17; or
wherein the vector comprises a polycistronic expression cassette, a transcriptional promoter element, and multiple nucleic acid coding sequences operably linked to a transcriptional promoter element.

* * * * *